US006869762B1

(12) United States Patent
Daly et al.

(10) Patent No.: US 6,869,762 B1
(45) Date of Patent: Mar. 22, 2005

(54) CROHN'S DISEASE-RELATED POLYMORPHISMS

(75) Inventors: Mark Daly, Arlington, MA (US);
Thomas J. Hudson, Westmount (CA);
Eric S. Lander, Cambridge, MA (US);
John Rioux, Cambridge, MA (US);
Kathy Siminovitch, Toronto (CA)

(73) Assignees: Whitehead Institute for Biomedical Research, Cambridge, MA (US);
Ellipsis Biotherapeutics Corporation, Toronto (CA)

( * ) Notice: Subject to any disclaimer, the term of this patent is extended or adjusted under 35 U.S.C. 154(b) by 252 days.

(21) Appl. No.: 09/735,271

(22) Filed: Dec. 11, 2000

Related U.S. Application Data

(60) Provisional application No. 60/196,046, filed on Apr. 10, 2000, and provisional application No. 60/170,257, filed on Dec. 10, 1999.

(51) Int. Cl.[7] .......................... C12Q 1/68; C12P 19/34; C07H 21/04
(52) U.S. Cl. ........................ 435/6; 435/91.1; 435/91.2; 536/23.1
(58) Field of Search .................... 435/6, 91.1, 91.2; 536/23.1, 24.3; 702/19, 20

(56) References Cited

U.S. PATENT DOCUMENTS

| 5,681,699 | A | 10/1997 | Rotter et al. | ............ 435/6 |
| 5,874,233 | A | 2/1999 | Targan et al. | ......... 435/7.24 |
| 5,916,748 | A | 6/1999 | Targan et al. | ............ 435/6 |
| 5,932,429 | A | 8/1999 | Targan et al. | ......... 435/7.24 |
| 6,008,335 | A | 12/1999 | Rotter et al. | ......... 536/23.1 |

FOREIGN PATENT DOCUMENTS

| WO | WO 86 00639 | 1/1986 |
| WO | WO 94 04196 | 3/1994 |
| WO | WO 95 21941 | 8/1995 |
| WO | WO 98 20165 | 5/1998 |
| WO | WO 98 38846 | 9/1998 |

OTHER PUBLICATIONS

S Lesage et al., Am.J.Hum.Genet.,"CARD15/NOD2 Mutational Analysis and Genotype–Phenotype Correlation in 612 Patients with Inflammatory Bowel Disease,"2002, 70:845–857.*
HH Over et al., European Journal of Gastroenterology and Hepatology,Oct. 1998,vol. 10, pp. 827–829, Abstract.*
A Rector et al., Genes and Immunity,"Mannan–binding lectin(MBL) gene polymorphisms in ulcerative colitis and Crohn's disease,"Oct. 2001, vol. 2, No. 6, pp. 323–328, Abstract.*
Cargill, M., et al., "Characterization of single–nucleotide polymorphisms in coding regions of human genes," *Nature Genetics*, 22: 231–238 (1999).
Fan, J., et al., "Genetic mapping: Finding and analyzing single–nucleotide polymorphisms with high–density DNA arrays," *Amer. Journal of Human Genetics*, 61(4): Abstract 1601 (1997).
Nakajima, A., et al., "HLA–linked susceptibility and resistance genes in Crohn's disease," *Gastroenterology*, 109: 1462–1467 (1995).
Rioux, J.D., et al., "Genomewide search in Canadian families with inflammatory bowel disease reveals two novel susceptibility loci," *Amer. Journal of Human Genetics*, 66: 1863–1870 (2000).

* cited by examiner

*Primary Examiner*—Jehanne Souaya
(74) *Attorney, Agent, or Firm*—Hamilton, Brook, Smith & Reynolds, P.C.

(57) ABSTRACT

The invention provides nucleic acid segments of the human genome, particularly nucleic acid segments from a gene, including polymorphic sites. Allele-specific primers and probes hybridizing to regions flanking or containing these sites are also provided. The nucleic acids, primers and probes are used in applications such as phenotype correlations, forensics, paternity testing, medicine and genetic analysis.

4 Claims, 1 Drawing Sheet

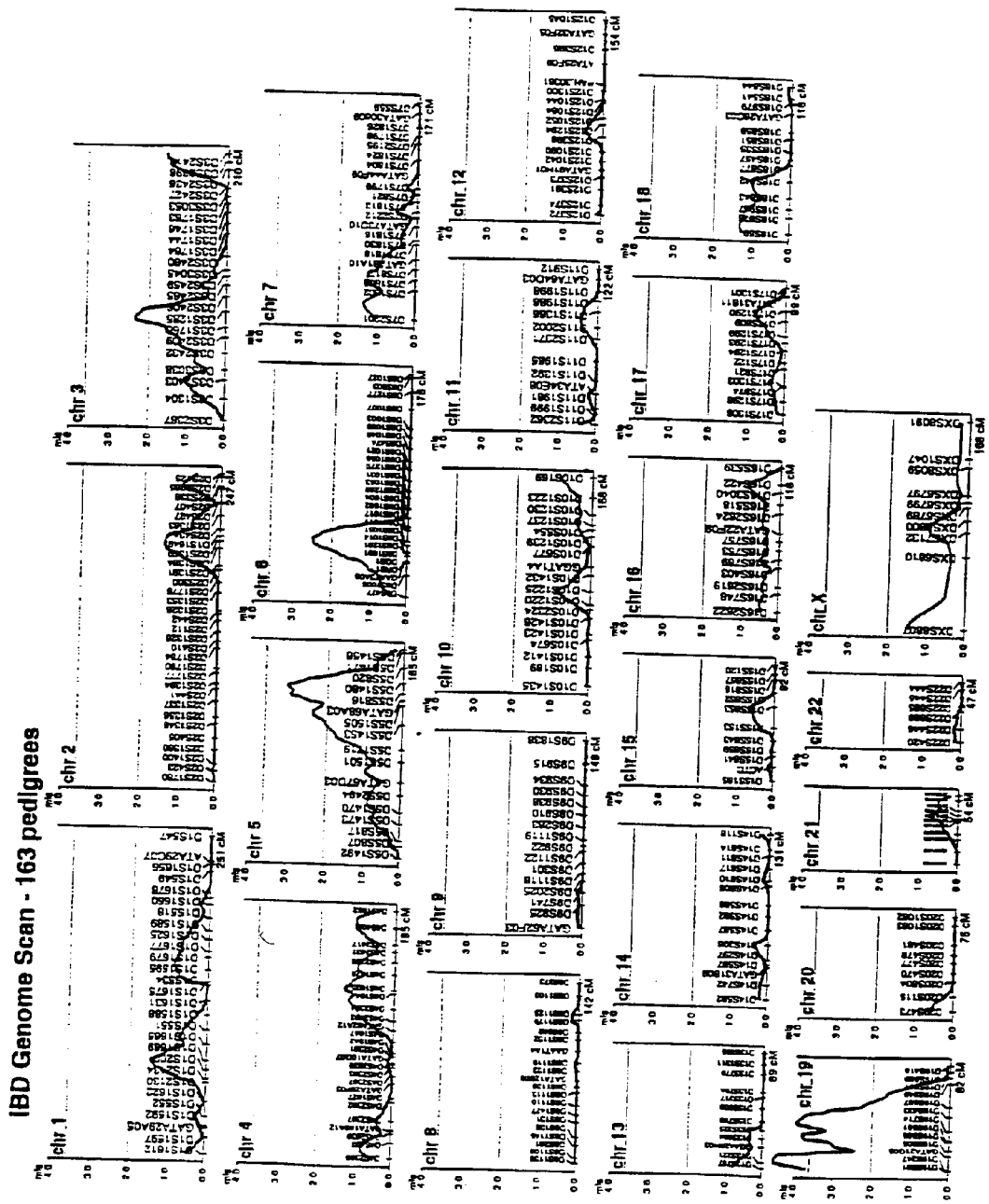
Figure

CROHN'S DISEASE-RELATED POLYMORPHISMS

RELATED APPLICATIONS

This application claims the benefit of U.S. Provisional Application Ser. No. 60/170,257, filed Dec. 10, 1999, and U.S. Provisional Application Ser. No. 60/196,046, filed Apr. 10, 2000, the entire teachings of both of which are incorporated herein by reference in their entirety.

BACKGROUND OF THE INVENTION

The genomes of all organisms undergo spontaneous mutation in the course of their continuing evolution, generating variant forms of progenitor nucleic acid sequences (Gusella, Ann. Rev. Biochem. 55, 831–854 (1986)). The variant form may confer an evolutionary advantage or disadvantage relative to a progenitor form, or may be neutral. In some instances, a variant form confers a lethal disadvantage and is not transmitted to subsequent generations of the organism. In other instances, a variant form confers an evolutionary advantage to the species and is eventually incorporated into the DNA of many or most members of the species and effectively becomes the progenitor form. In many instances, both progenitor and variant form(s) survive and coexist in a species population. The coexistence of multiple forms of a sequence gives rise to polymorphisms.

Several different types of polymorphism have been reported. A restriction fragment length polymorphism (RFLP) is a variation in DNA sequence that alters the length of a restriction fragment (Botstein et al., Am. J. Hum. Genet. 32, 314–331 (1980)). The restriction fragment length polymorphism may create or delete a restriction site, thus changing the length of the restriction fragment. RFLPs have been widely used in human and animal genetic analyses (see WO 90/13668; WO90/11369; Donis-Keller, Cell 51, 319–337 (1987); Lander et al., Genetics 121, 85–99 (1989)). When a heritable trait can be linked to a particular RFLP, the presence of the RFLP in an individual can be used to predict the likelihood that the animal will also exhibit the trait.

Other polymorphisms take the form of short tandem repeats (STRs) that include tandem di-, tri- and tetra-nucleotide repeated motifs. These tandem repeats are also referred to as variable number tandem repeat (VNTR) polymorphisms. VNTRs have been used in identity and paternity analysis (U.S. Pat. No. 5,075,217; Armour et al., FEBS Lett. 307, 113–115 (1992); Horn et al., WO 91/14003; Jeffreys, EP 370,719), and in a large number of genetic mapping studies.

Other polymorphisms take the form of single nucleotide variations between individuals of the same species. Such polymorphisms are far more frequent than RFLPs, STRs and VNTRs. Some single nucleotide polymorphisms (SNP) occur in protein-coding nucleic acid sequences (coding sequence SNP (cSNP)), in which case, one of the polymorphic forms may give rise to the expression of a defective or otherwise variant protein and, potentially, a genetic disease. Examples of genes in which polymorphisms within coding sequences give rise to genetic disease include β-globin (sickle cell anemia), apoE4 (Alzheimer's Disease), Factor V Leiden (thrombosis), and CFTR (cystic fibrosis). cSNPs can alter the codon sequence of the gene and therefore specify an alternative amino acid. Such changes are called "missense" when another amino acid is substituted, and "nonsense" when the alternative codon specifies a stop signal in protein translation. When the cSNP does not alter the amino acid specified the cSNP is called "silent". Other single nucleotide polymorphisms occur in noncoding regions. Some of these polymorphisms may also result in defective protein expression (e.g., as a result of defective splicing). Other single nucleotide polymorphisms have no phenotypic effects.

Single nucleotide polymorphisms can be used in the same manner as RFLPs and VNTRs, but offer several advantages. Single nucleotide polymorphisms occur with greater frequency and are spaced more uniformly throughout the genome than other forms of polymorphism. The greater frequency and uniformity of single nucleotide polymorphisms means that there is a greater probability that such a polymorphism will be found in close proximity to a genetic locus of interest than would be the case for other polymorphisms. The different forms of characterized single nucleotide polymorphisms are often easier to distinguish than other types of polymorphism (e.g., by use of assays employing allele-specific hybridization probes or primers).

Only a small percentage of the total repository of polymorphisms in humans and other organisms has been identified. The limited number of polymorphisms identified to date is due to the large amount of work required for their detection by conventional methods. For example, a conventional approach to identifying polymorphisms might be to sequence the same stretch of DNA in a population of individuals by dideoxy sequencing. In this type of approach, the amount of work increases in proportion to both the length of sequence and the number of individuals in a population and becomes impractical for large stretches of DNA or large numbers of persons.

SUMMARY OF THE INVENTION

Work described herein pertains to the identification of polymorphisms which are associated with inflammatory bowel diseases (IBD), and particularly those within a single risk haplotype, by resequencing large numbers of genes and gene fragments in a large number of individuals. Various genes from a number of individuals have been resequenced as described herein, and SNPs in these genes have been discovered (see Table 3). Some of these SNPs are cSNPs which specify a different amino acid sequence, some of the SNPs are silent cSNPs and some of these cSNPs specify a stop signal in protein translation. Some of the identified SNPs were located in non-coding regions.

With the goal of identifying IBD susceptibility genes, a genomewide scan was undertaken in 163 pedigrees, and three regions of suggestive linkage (3, 5q31–33, 9p) and one of significant linkage to 19p13 (LOD=4.6) were identified. Higher density mapping in the suggestive 5q31–33 region revealed a CD susceptibility locus of genome-wide significance (LOD=3.9). Importantly, the 5q31–p33 localizes to the major immunoregulatory cytokine gene cluster and the 19p13 locus to a region containing numerous genes encoding cytokine/chemokine receptors and other inflammatory-associated molecules that could have a direct role in disease susceptibility.

In order to pursue the evidence of linkage to chromosome 5, a systematic linkage disequilibrium (LD) approach was adopted. The approach that was used in the first stage of LD mapping was to genotype all known microsatellite markers in the 18 cM between D5S1435 and D5S1480, as these two markers delimit a region of a 2 LOD drop on either side of the linkage peak centered at marker D5S2497. All alleles for each marker were examined for evidence of excess transmission from heterozygous parents to CD child using the transmission disequilibrium test (TDT). Only alleles at two of the 57 markers had significant $C^2$ results (p<0.001): IRF9p1 ($C^2$=13.3, p=0.0003) and D5S1984 ($C^2$=14.0, p=0.0002) (Table 1). A second stage of mapping was then undertaken to confirm, as well as to better delimit, the region of LD surrounding IRF9p1 and D5S1984. The development of new microsatellite markers was necessary. The marker with the most significant $C^2$ result was CAh16a ($C^2$=16.2, p=0.00006) and was located between IRF9p1 and D5S1984 (Table 2). Furthermore, the alleles 193, 156, 373, 140, 222, and 307 at markers GAh16a, IRF9p, CAh16a, CAh16a, D5S1984, CSF9p10, respectively, define a haplotype conferring susceptibility to Crohn's disease (CD). In order to identify the sequence variant that would explain the genetic susceptibility to CD provided by this haplotype, a search was performed for all single nucleotide polymorphisms (SNPs) in this region of LD. The SNP discovery was accomplished by direct sequencing of overlapping PCR products amplified from DNA samples from eight individuals (six CD patients, one unaffected family member, and one CEPH DNA as control). Table 3 shows the results of the SNP discovery analyses. 139 triads were genotyped for a total of 241 SNPs thus far, where at least 50 trios were fully genotyped. Using a $C^2$ value of 13 (corresponding to a p-value of 0.05) as threshold, 12 SNPs were found to have a significant level of association with CD and extended over a region of 250 kb, from IRF1 to proly14 hydroxylase. These were markers IGR2056a_1, IGR2060a_1, IGR2063b_1, IGR2066a_2, IGR2076a_1, IGR2096a_1, IGR2196a_1, IGR2230a_1, IGR2276a_1, IGR3081 a_1, IGR3096a_1, PROLYLex3_1 (see Table 4). Any of these best SNPs by themselves are in strong association with CD and fully explain the microsatellite LD observations. Furthermore, the best SNPs have nearly identical association characteristics (that is, the allele at one SNP determines the allele of all others on any phased chromosome), confirming that a single risk haplotype extending approximately 250 kb is the source of all the observations of association in this region. Specifically, this haplotype is defined by the alleles G, C, G, T, A, A, G, T, G, G, C, T at markers IGR2056a_1, IGR2060a_1, IGR2063b_1, IGR2066a_2, IGR2076a_1, IGR2096a_1, IGR2196a_1, IGR2230a_1, IGR2276a_1, IGR3086a_1, IGR3096a_1, PROLYLex3_1, respectively. The frequency of this haplotype is estimated to be approximately 37% in the general population. Furthermore, this haplotype is transmitted from heterozygous parents to CD patients at a ratio of 2.5:1.

The invention relates to a isolated gene or nucleic acid molecule which comprises a single nucleotide polymorphism at a specific location. In a particular embodiment the invention relates to the variant allele of a gene having a single nucleotide polymorphism, which variant allele differs from a reference allele by one nucleotide at the site(s) identified in Table 3. Complements of these nucleic acid segments are also included. The segments can be DNA or RNA, and can be double- or single-stranded. Segments can be, for example, 5–10, 5–15, 10–20, 5–25, 10–30, 10–50 or 10–100 bases long.

The invention further provides allele-specific oligonucleotides that hybridize to a gene comprising a single nucleotide polymorphism or to the complement of the gene. These oligonucleotides can be probes or primers.

The invention further provides a method of analyzing a nucleic acid from an individual. The method determines which base is present at any one of the polymorphic sites shown in Table 3. Optionally, a set of bases occupying a set of the polymorphic all sites shown in Table 3 is determined. This type of analysis can be performed on a number of individuals, who are tested for the presence of a disease phenotype. The presence or absence of disease phenotype is then correlated with a base or set of bases present at the polymorphic site or sites in the individuals tested.

Thus, the invention further relates to a method of predicting the presence, absence, likelihood of the presence or absence, or severity of a particular phenotype or disorder associated with a particular genotype. The method comprises obtaining a nucleic acid sample from an individual and determining the identity of one or more bases (nucleotides) at polymorphic sites of genes described herein, wherein the presence of a particular base is correlated with a specified phenotype or disorder, thereby predicting the presence, absence, likelihood of the presence or absence, or severity of the phenotype or disorder in the individual. In one embodiment of the invention, the phenotype is inflammatory bowel disease or Crohn's disease.

BRIEF DESCRIPTION OF THE DRAWING

The Figure shows multipoint nonparametric linkage results for the IBD genome scan. Multipoint LOD scores were calculated using the MAPMAKER/SIBS functions implemented in GENHUNTER 2.0. The thick black line indicates the LOD score along the length of each chromosome, and the tick marks indicate the position of the microsatellite markers. The two horizontal lines depict the genome-wide thresholds for suggestive (LOD=2.0) and significant linkage.

DETAILED DESCRIPTION OF THE INVENTION

Crohn's disease (CD) and ulcerative colitis (UC) are chronic, idiopathic inflammatory disorders of the gastrointestinal tract. These inflammatory bowel diseases (IBD) have a peak incidence in early adulthood, and their combined prevalence is approximately 100–200/100,000. The inflammation in IBD is characterized by altered expression of both pro-inflammatory and immunoregulatory cytokines in the affected intestinal mucosa (Kmiec, *Arch Immunol TherExpe (Warsz)* 46(3):143–155 (1998)). Genetic factors are believed to play an important role, as the sibling risk ($\lambda_s$) calculated for IBD ranges from 15–40, with a stronger genetic contribution occurring for CD ($\lambda_s$~35) as compared to UC ($\lambda_s$~15). Additionally, relatives of individuals with IBD diagnosed at younger ages appear to be at an even higher risk.

CD is characterized by discontinuous, transmural inflammation affecting any part of the gastrointestinal tract and is manifested by abdominal pain, chronic diarrhea, weight loss, bowel obstructions and fistulae. UC occurs as a continuous, mucosal inflammation affecting only the large intestine with primary symptoms including diarrhea, rectal bleeding and abdominal pain. The search for susceptibility genes for these two diseases has resulted in the identification of two potential susceptibility loci. The first, called IBD1, is a CD-susceptibility locus that lies in the pericentromeric region of chromosome 16 (Hugo et al., *Nature* 379:821–822 (1996)). The second (IBD2) is located in a 41 cM region surrounding marker D12S83 and appears to be linked to both CD and UC (Satsangi et al., *Genetics* 14:199–202 (1996)). These putative loci, however, have only been replicated in some, but not all, subsequent studies (Cavanaugh et al., *Proc Natl Acad Sci USA* 62:291–298 (1998); Cho et al., *The National Academy of Sciences* 95:7502–7507 (1998); Curren et al., *Gastroenterology* 115:1–7 (1998); Duerr et al., *The American Society of Human Genetics* 63:95–100 (1998); Rioux et al., *Am. J. Hum. Genet.* 63:1086–1094 (1998); Yang et al., *Gastroenterology* 109:440–448 (1995)), supporting the belief that there exists substantial genetic heterogeneity. Furthermore, IBD1 and IBD2 only account for a fraction of the heritability of IBD, suggesting that additional loci contribute to disease susceptibility. Thus, as described herein, the susceptibility loci in a Canadian IBD population was assessed by studying families with multiple affected siblings (McLeod et al., *Dis Colon Rectum* 40:553–557 (1997)).

A genome-wide screen was performed on 181 IBD-affected sibling pairs (ASP) and 5 IBD-affected relative pairs (RP) from 163 families. Among these ASP, 122 were CD pairs, 25 were UC pairs, and 34 were "mixed" pairs (one sibling with either CD or UC, the other with CD, UC or IC).

All ASP and available parents (140 families had both parents available, 17 had one parent available, and 1 was missing both parents), as well as all RP, were genotyped with 312 microsatellite markers covering the genome with approximately 12 cM distance between markers. Simulations of this dataset 4 indicated that the genome-wide threshold for suggestive linkage (the score expected to occur one time at random in a genome scan) was at a LOD of 2.0. Using either this calculated threshold, or the published threshold of LOD 2.2 based on an infinitely dense map (Lander & Kruglyak, *Nature Genetics* 11:241–247 (1995)), multipoint nonparametric linkage analysis of these data revealed 4 loci which surpassed this threshold (Figure). Specifically, chromosome 3 had a peak LOD of 2.4 between markers D3S1766 and D#S1285, chromosome 5 a peak LOD of 3.0 between GATA68A03 and D5S816, chromosome 6 a peak LOD of 2.3 between D6S1019 and D6S1017, and chromosome 19 a peak LOD of 4.6 between GATA21G05 and D 19S586. In fact this chromosome 19 locus exceeds the threshold for genome-wide significance of 3.6 (Lander & Kruglyak, *Nature Genetics* 11:241–247 (1995)), and represents a novel IBD susceptibility locus.

This novel locus maps to an extended region on 19p13 (Figure) that contains many different genes of immunologic interest such as intercellular adhesion molecule 1 (ICAMI), complement component 3 (C3), the thromboxane A2 receptor (TBXA2), leukotriene B4 hydroxylase (LTB4H), and the janus tyrosine kinases TYK2 and JAK3. There is some evidence supporting their relevance in IBD susceptibility: 1) modest positive association results have been reported for the ICAMI (Yang et al., *Gastroenterology* 109:440–448 (1995)) and C3 molecules (Elmgreen et al., *Acta Med Scand* 215(4):375–8 (1984)); 2) attempts to interfere with the TBXA2 (Taniguchi, 1997) and LTB4 (Hawkey et al., *Agents Actions, Special Conference Issue* (1992)) mediated inflammatory pathways have shown some therapeutic value; and 3) the janus kinases have been shown to be important in the transduction of the molecular signal from cytokine receptors.

The finding of suggestive linkage to an approximately 30 cM region spanning the cytokine gene cluster on 5q31–q33, containing many of the immunoregulatory cytokines such as ILA, IL13, EL5 and EL3, led to the performance of higher density mapping in this region. Specifically, the original families and an additional 12 families were genotyped for 34 extra microsatellite markers. Multipoint nonparametric analysis were then performed using three different phenotypic categories: IBD, CD and CD16. In the first, all individuals with CD, UC or IC were designated as affected; in the second, only individuals with CD were designated as affected; in the third, only individuals with CD were designated as affected and only families with at least one affected sibling diagnosed at the age of 16 or younger were included. This last category was examined due to an expected enrichment for genetic factors over environmental causes. These analyses demonstrate the presence of a locus of genome-wide significance in the group with early onset CD (MLS 3.9). Evidence for linkage to the syntenic region in mice has been reported in an induced model of colitis (Mahler, *Genomics* 55:147–156 (1999)).

Although the suggestive loci on chromosomes 3 and 6 identified as described herein have not yet been followed up with higher density mapping, it is important to note that the linkage peak on chromosome 3 is approximately 10 cM away from a previously reported suggestive locus (Satsangi et al., *Nature Genetics* 14:199–202 (1996)), and the linkage peak on 6 lies approximately 20 cM centromeric to the major histocompatibility complex (MHC) Class H region. A recent study has described linkage to this chromosome 6 region (Hampe et al., *Am. J. Hum. Genet.* 64 (1999)), and a large meta-analysis of the results derived from 29 different studies has also reported that both CD and UC were associated with specific Class I alleles (Stokkers et al., *Gut* 45:395–401 (1999)). Finally, in order to assess whether the IBD1 and IBD2 loci are contributing to the IBD susceptibility in this population, exclusion mapping of the data was performed. These analyses demonstrate that the entire chromosome 12 can be excluded for loci of even modest effects ($\lambda_s > 1.5$), but can only loci conferring a $\lambda_s > 4$ on chromosome 16 can be excluded, suggesting that IBD1 ($\lambda_s \sim 1.3$) could have gone undetected in the present study.

Thus, this work has identified two novel susceptibility loci: a locus on chromosome 5q31–33 that confers susceptibility to CD and a locus on chromosome 19p13 that confers susceptibility to IBD. Furthermore, particular SNPs within these loci have been identified which may be associated with disease susceptibility.

The present invention relates to a gene which comprises a single nucleotide polymorphism (SNP) at a specific location. The gene which includes the SNP has at least two alleles, referred to herein as the reference allele and the variant allele. The reference allele (prototypical or wild type allele) has been designated arbitrarily and typically corresponds to the nucleotide sequence of the gene which has been deposited with GenBank or TIGR under a given Accession number. The variant allele differs from the reference allele by one nucleotide at the site(s) identified in Table 3. The present invention also relates to variant alleles of the described genes and to complements of the variant alleles. The invention further relates to portions of the variant alleles and portions of complements of the variant alleles which comprise (encompass) the site of the SNP and are at least 5 nucleotides in length. Portions can be, for example, 5–10, 5–15, 10–20, 5–25, 10–30, 10–50 or 10–100 bases long. For example, a portion of a variant allele which is 21 nucleotides in length includes the single nucleotide polymorphism (the nucleotide which differs from the reference allele at that site) and twenty additional nucleotides which flank the site in the variant allele. These nucleotides can be on one or both sides of the polymorphism.

Polymorphisms which are the subject of this invention are defined in Table 3. The reference sequence for many of the genes or gene fragments is provided in Table 5. For sequences which are not present in Table 5, the skilled artisan can readily determine the specific location of the polymorphism given the 3' and 5' nucleotide sequence flanking the polymorphic site provided in Table 3 and the chromosomal loci information provided herein. The nucleotide sequences of the invention can be double- or single-stranded.

The invention further provides allele-specific oligonucleotides that hybridize to a gene comprising a single nucleotide polymorphism or to the complement of the gene. These oligonucleotides can be probes or primers.

The invention further provides a method of analyzing a nucleic acid from an individual. The method determines which base is present at any one of the polymorphic sites shown in Table 3. Optionally, a set of bases occupying a set of the polymorphic sites shown in Table 3 is determined. This type of analysis can be performed on a number of individuals, who are tested for the presence of a disease phenotype. The presence or absence of disease phenotype is then correlated with a base or set of bases present at the polymorphic site or sites in the individuals tested.

Thus, the invention further relates to a method of predicting the presence, absence, likelihood of the presence or absence, or severity of a particular phenotype or disorder associated with a particular genotype. The method comprises obtaining a nucleic acid sample from an individual and determining the identity of one or more bases (nucleotides) at polymorphic sites of genes described herein, wherein the presence of a particular base is correlated with a specified phenotype or disorder, thereby predicting the presence, absence, likelihood of the presence or absence, or severity of the phenotype or disorder in the individual.

Definitions

An oligonucleotide can be DNA or RNA, and single- or double-stranded. Oligonucleotides can be naturally occurring or synthetic, but are typically prepared by synthetic means. Preferred oligonucleotides of the invention include segments of DNA, or their complements, which include any one of the polymorphic sites shown in Table 3. The segments can be between 5 and 250 bases, and, in specific embodiments, are between 5–10, 5–20, 10–20, 10–50, 2050 or 10–100 bases. For example, the segment can be 21 bases. The polymorphic site can occur within any position of the segment. The segments can be from any of the allelic forms of DNA shown in Table 3.

As used herein, the terms "nucleotide", "base" and "nucleic acid" are intended to be equivalent. The terms "nucleotide sequence", "nucleic acid sequence", "nucleic acid molecule" and "segment" are intended to be equivalent.

Hybridization probes are oligonucleotides which bind in a base-specific manner to a complementary strand of nucleic acid. Such probes include peptide nucleic acids, as described in Nielsen et al., *Science* 254, 1497–1500 (1991). Probes can be any length suitable for specific hybridization to the target nucleic acid sequence. The most appropriate length of the probe may vary depending upon the hybridization method in which it is being used; for example, particular lengths may be more appropriate for use in microfabricated arrays, while other lengths may be more suitable for use in classical hybridization methods. Such optimizations are known to the skilled artisan. Suitable probes and primers can range from about 5 nucleotides to about 30 nucleotides in length. For example, probes and primers can be 5, 6, 8, 10, 12, 14, 16, 18, 20, 22, 24, 25, 26, 28 or 30 nucleotides in length. The probe or primer preferably overlaps at least one polymorphic site occupied by any of the possible variant nucleotides. The nucleotide sequence can correspond to the coding sequence of the allele or to the complement of the coding sequence of the allele.

As used herein, the term "primer" refers to a single-stranded oligonucleotide which acts as a point of initiation of template-directed DNA synthesis under appropriate conditions (e.g., in the presence of four different nucleoside triphosphates and an agent for polymerization, such as DNA or RNA polymerase or reverse transcriptase) in an appropriate buffer and at a suitable temperature. The appropriate length of a primer depends on the intended use of the primer, but typically ranges from 15 to 30 nucleotides. Short primer molecules generally require cooler temperatures to form sufficiently stable hybrid complexes with the template. A primer need not reflect the exact sequence of the template, but must be sufficiently complementary to hybridize with a template. The term primer site refers to the area of the target DNA to which a primer hybridizes. The term primer pair refers to a set of primers including a 5' (upstream) primer that hybridizes with the 5' end of the DNA sequence to be amplified and a 3' (downstream) primer that hybridizes with the complement of the 3' end of the sequence to be amplified.

As used herein, linkage describes the tendency of genes, alleles, loci or genetic markers to be inherited together as a result of their location on the same chromosome. It can be measured by percent recombination between the two genes, alleles, loci or genetic markers.

As used herein, polymorphism refers to the occurrence of two or more genetically 1, determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic or biallelic polymorphism has two forms. A triallelic polymorphism has three forms.

Work described herein pertains to the resequencing of large numbers of genes in a large number of individuals to identify polymorphisms which can predispose individuals to disease, particularly IBD.

By altering amino acid sequence, SNPs may alter the function of the encoded proteins. The discovery of the SNP facilitates biochemical analysis of the variants and the development of assays to characterize the variants and to screen for pharmaceutical that would interact directly with on or another form of the protein. SNPs (including silent SNPs) may also alter the regulation of the gene at the transcriptional or post-transcriptional level. SNPs (including silent SNPs) also enable the development of specific DNA, RNA, or protein-based diagnostics that detect the presence or absence of the polymorphism in particular conditions.

A single nucleotide polymorphism occurs at a polymorphic site occupied by a single nucleotide, which is the site of variation between allelic sequences. The site is usually preceded by and followed by highly conserved sequences of the allele (e.g., sequences that vary in less than 1/100 or 1/1000 members of the populations).

A single nucleotide polymorphism usually arises due to substitution of one nucleotide for another at the polymorphic site. A transition is the replacement of one purine by another purine or one pyrimidine by another pyrimidine. A transversion is the replacement of a purine by a pyrimidine or vice versa Single nucleotide polymorphisms can also arise from a deletion of a nucleotide or an insertion of a nucleotide relative to a reference allele. Typically the polymorphic site is occupied by a base other than the reference base. For example, where the reference allele contains the base "T" at the polymorphic site, the altered allele can contain a "C", "G" or "A" at the polymorphic site.

Hybridizations are usually performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25–30° C., or equivalent conditions, are suitable for allele-specific probe hybridizations. Equivalent conditions can be determined by varying one or more of the parameters given as an example, as known in the art, while maintaining a similar degree of identity or similarity between the target nucleotide sequence and the primer or probe used.

The term "isolated" is used herein to indicate that the material in question exists in a physical milieu distinct from that in which it occurs in nature. For example, an isolated nucleic acid of the invention may be substantially isolated with respect to the complex cellular milieu in which it naturally occurs. In some instances, the isolated material will form part of a composition (for example, a crude extract containing other substances), buffer system or reagent mix. In other circumstance, the material may be purified to essential homogeneity, for example as determined by PAGE or column chromatography such as HPLC. Preferably, an isolated nucleic acid comprises at least about 50, 80 or 90 percent (on a molar basis) of all macromolecular species present.

I. Novel Polymorphisms of the Invention

The novel polymorphisms of the invention are shown in Table 3.

II. Analysis of Polymorphisms

A. Preparation of Samples

Polymorphisms are detected in a target nucleic acid from an individual being analyzed. For assay of genomic DNA, virtually any biological sample (other than pure red blood cells) is suitable. For example, convenient tissue samples include whole blood, semen, saliva, tears, urine, fecal material, sweat, buccal, skin and hair. For assay of cDNA or mRNA, the tissue sample must be obtained from an organ in which the target nucleic acid is expressed. For example, if the target nucleic acid is a cytochrome P450, the liver is a suitable source.

Many of the methods described below require amplification of DNA from target samples. This can be accomplished by e.g., PCR. See generally *PCR Technology: Principles and Applications for DNA Amplification* (ed. H. A. Erlich, Freeman Press, NY, N.Y., 1992); PCR Protocols: *A Guide to Methods and Applications* (eds. Innis, et al., Academic Press, San Diego, Calif., 1990); Mattila et al., *Nucleic Acids Res.* 19, 4967 (1991); Eckert et al., *PCR Methods and Applications* 1, 17 (1991); PCR (eds. McPherson et al., IRL Press, Oxford); and U.S. Pat. No. 4,683,202.

Other suitable amplification methods include the ligase chain reaction (LCR) (see Wu and Wallace, Genomics 4, 560 (1989), Landegren et al., *Science* 241, 1077 (1988), transcription amplification (Kwob et al., *Proc. Natl. Acad. Sci. USA* 86, 1173 (1989)), and self-sustained sequence replication (Guatelli et al., *Proc. Nat. Acad. Sci. USA,* 87, 1874 (1990)) and nucleic acid based sequence amplification (NASBA). The latter two amplification methods involve isothermal reactions based on isothermal transcription, which produce both single stranded RNA (ssRNA) and double stranded DNA (dsDNA) as the amplification products in a ratio of about 30 or 100 to 1, respectively.

B. Detection of Polymorphisms in Target DNA

The polymorphisms identified as described herein can be used as a platform for genotyping (i.e., determining the genotype of) individuals. This analysis determines which form(s) of a characterized (known) polymorphism are present in individuals under test. There are a variety of suitable procedures, which are discussed in turn.

1. Allele-Specific Probes The design and use of allele-specific probes for analyzing polymorphisms is described by e.g., Saiki et al., *Nature* 324, 163–166 (1986); Dattagupta, EP 235,726, Saiki, WO 89/11548. Allele-specific probes can be designed that hybridize to a segment of target DNA from one individual but do not hybridize to the corresponding segment from another individual due to the presence of different polymorphic forms in the respective segments from the two individuals. Hybridization conditions should be sufficiently stringent that there is a significant difference in hybridization intensity between alleles, and preferably an essentially binary response, whereby a probe hybridizes to only one of the alleles. Some probes are designed to hybridize to a segment of target DNA such that the polymorphic site aligns with a central position (e.g., in a 15-mer at the 7 position; in a 16-mer, at either the 8 or 9 position) of the probe. This design of probe achieves good discrimination in hybridization between different allelic forms.

Allele-specific probes are often used in pairs, one member of a pair showing a perfect match to a reference form of a target sequence and the other member showing a perfect match to a variant form. Several pairs of probes can then be immobilized on the same support for simultaneous analysis of multiple polymorphisms within the same target sequence.

2. Tiling Arrays

The polymorphisms can also be identified by hybridization to nucleic acid arrays, some examples of which are described in WO 95/11995. One form of such arrays is described in the Examples section in connection with de novo identification of polymorphisms. The same array or a different array can be used for analysis of characterized polymorphisms. WO 95/11995 also describes subarrays that are optimized for detection of a variant form of a precharacterized polymorphism. Such a subarray contains probes designed to be complementary to a second reference sequence, which is an allelic variant of the first reference sequence. The second group of probes is designed by the same principles as described in the Examples, except that the probes exhibit complementarity to the second reference sequence. The inclusion of a second group (or further groups) can be particularly useful for analyzing short subsequences of the primary reference sequence in which multiple mutations are expected to occur within a short distance commensurate with the length of the probes (e.g., two or more mutations within 9 to 21 bases).

3. Allele-Specific Primers

An allele-specific primer hybridizes to a site on target DNA overlapping a polymorphism and only primes amplification of an allelic form to which the primer exhibits perfect complementarity. See Gibbs, *Nucleic Acid Res.* 17, 2427–2448 (1989). This primer is used in conjunction with a second primer which hybridizes at a distal site. Amplification proceeds from the two primers, resulting in a detectable product which indicates the particular allelic form is present. A control is usually performed with a second pair of primers, one of which shows a single base mismatch at the polymorphic site and the other of which exhibits perfect complementarity to a distal site. The single-base mismatch prevents amplification and no detectable product is formed. The method works best when the mismatch is included in the 3'-most position of the oligonucleotide aligned with the polymorphism because this position is most destabilizing to elongation from the primer (see, e.g., WO 93/22456).

4. Direct-Sequencing

The direct analysis of the sequence of polymorphisms of the present invention can be accomplished using either the dideoxy chain termination method or the Maxam-Gilbert method (see Sambrook et al., Molecular Cloning, A Laboratory Manual (2nd Ed., CSHP, New York 1989); Zyskind et al., *Recombinant DNA Laboratory Manual,* (Acad. Press, 1988)).

5. Denaturing Gradient Gel Electrophoresis

Amplification products generated using the polymerase chain reaction can be analyzed by the use of denaturing gradient gel electrophoresis. Different alleles can be identified based on the different sequence-dependent melting properties and electrophoretic migration of DNA in solution. Erlich, ed., *PCR Technology, Principles and Applications for DNA Amplification,* (W.H. Freeman and Co, New York, 1992), Chapter 7.

6. Single-Strand Conformation Polymorphism Analysis

Alleles of target sequences can be differentiated using single-strand conformation polymorphism analysis, which identifies base differences by alteration in electrophoretic migration of single stranded PCR products, as described in Orita et al., *Proc. Nat. Acad. Sci.* 86, 2766–2770 (1989). Amplified PCR products can be generated as described above, and heated or otherwise denatured, to form single stranded amplification products. Single-stranded nucleic acids may refold or form secondary structures which are partially dependent on the base sequence. The different electrophoretic mobilities of single-stranded amplification products can be related to base-sequence differences between alleles of target sequences.

7. Single Base Extension

An alternative method for identifying and analyzing polymorphisms is based on single-base extension (SBE) of a fluorescently-labeled primer coupled with fluorescence resonance energy transfer (FRET) between the label of the added base and the label of the primer. Typically, the method, such as that described by Chen et al., (*PNAS* 94:10756–61 (1997), incorporated herein by reference) uses a locus-specific oligonucleotide primer labeled on the 5' terminus with 5-carboxyfluorescein (FAM).

This labeled primer is designed so that the 3' end is immediately adjacent to the polymorphic site of interest. The labeled primer is hybridized to the locus, and single base extension of the labeled primer is performed with fluorescently labeled dideoxyribonucleotides (ddNTPs) in dye-terminator sequencing fashion, except that no deoxyribonucleotides are present. An increase in fluorescence of the added ddNTP in response to excitation at the wavelength of the labeled primer is used to infer the identity of the added nucleotide.

III. Methods of Use

After determining polymorphic form(s) present in an individual at one or more polymorphic sites, this information can be used in a number of methods.

A. Forensics

Determination of which polymorphic forms occupy a set of polymorphic sites in an individual identifies a set of polymorphic forms that distinguishes the individual. See generally National Research Council, *The Evaluation of Forensic DNA Evidence* (Eds. Pollard et al., *National Academy Press, DC*, 1996). The more sites that are analyzed, the lower the probability that the set of polymorphic forms in one individual is the same as that in an unrelated individual. Preferably, if multiple sites are analyzed, the sites are unlinked. Thus, polymorphisms of the invention are often used in conjunction with polymorphisms in distal genes. Preferred polymorphisms for use in forensics are biallelic because the population frequencies of two polymorphic forms can usually be determined with greater accuracy than those of multiple polymorphic forms at multi-allelic loci.

The capacity to identify a distinguishing or unique set of forensic markers in an individual is useful for forensic analysis. For example, one can determine whether a blood sample from a suspect matches a blood or other tissue sample from a crime scene by determining whether the set of polymorphic forms occupying selected polymorphic sites is the same in the suspect and the sample. If the set of polymorphic markers does not match between a suspect and a sample, it can be concluded (barring experimental error) that the suspect was not the source of the sample. If the set of markers does match, one can conclude that the DNA from the suspect is consistent with that found at the crime scene. If frequencies of the polymorphic forms at the loci tested have been determined (e.g., by analysis of a suitable population of individuals), one can perform a statistical analysis to determine the probability that a match of suspect and crime scene sample would occur by chance.

p(ID) is the probability that two random individuals have the same polymorphic or allelic form at a given polymorphic site. In biallelic loci, four genotypes are possible: AA, AB, BA, and BB. If alleles A and B occur in a haploid genome of the organism with frequencies x and y, the probability of each genotype in a diploid organism is (see WO 95/12607):

Homozygote: $p(AA)=x^2$

Homozygote: $p(BB)=y^2=(1-x)^2$

Single Heterozygote: $p(AB)=p(BA)=xy=x(1-x)$

Both Heterozygotes: $p(AB+BA)=2xy=2x(1-x)$

The probability of identity at one locus (i.e, the probability that two individuals, picked at random from a population will have identical polymorphic forms at a given locus) is given by the equation:

$$p(ID)=(x^2)^2+(2xy)^2+(y^2)^2.$$

These calculations can be extended for any number of polymorphic forms at a given locus. For example, the probability of identity p(ID) for a 3-allele system where the alleles have the frequencies in the population of x, y and z, respectively, is equal to the sum of the squares of the genotype frequencies:

$$p(ID)=x^4+(2xy)^2+(2yz)^2+(2xz)^2+z^4+y^4$$

In a locus of n alleles, the appropriate binomial expansion is used to calculate p(ID) and p(exc).

The cumulative probability of identity (cum p(ID)) for each of multiple unlinked loci is determined by multiplying the probabilities provided by each locus.

$$cum\ p(ID)=p(ID1)p(ID2)p(ID3)\ldots p(IDn)$$

The cumulative probability of non-identity for n loci (i.e. the probability that two random individuals will be different at 1 or more loci) is given by the equation:

$$cum\ p(nonID)=1-cum\ p(ID).$$

If several polymorphic loci are tested, the cumulative probability of non-identity for random individuals becomes very high (e.g., one billion to one). Such probabilities can be taken into account together with other evidence in determining the guilt or innocence of the suspect.

B. Paternity Testing

The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child.

If the set of polymorphisms in the child attributable to the father does not match the set of polymorphisms of the putative father, it can be concluded, barring experimental error, that the putative father is not the real father. If the set of polymorphisms in the child attributable to the father does match the set of polymorphisms of the putative father, a statistical calculation can be performed to determine the probability of coincidental match.

The probability of parentage exclusion (representing the probability that a random male will have a polymorphic form at a given polymorphic site that makes him incompatible as the father) is given by the equation (see WO 95/12607):

$$p(exc)=xy(1-xy)$$

where x and y are the population frequencies of alleles A and B of a biallelic polymorphic site.

(At a triallelic site $p(exc)=xy(1-xy)+yz(1-yz)+xz(1-xz)+3xyz(1-xyz)$)), where x, y and z and the respective population frequencies of alleles A, B and C).

The probability of non-exclusion is $$p(non-exc)=1-p(exc)$$

The cumulative probability of non-exclusion (representing the value obtained when n loci are used) is thus:

$$cum\ p(non-exc)=p(non-exc1)p(non-exc2)p(non-exc3)\ldots p(non-excn)$$

The cumulative probability of exclusion for n loci (representing the probability that a random male will be excluded)

$$cum\ p(exc)=1-cum\ p(non-exc).$$

If several polymorphic loci are included in the analysis, the cumulative probability of exclusion of a random male is very high. This probability can be taken into account in assessing the liability of a putative father whose polymorphic marker set matches the child's polymorphic marker set attributable to his/her father.

C. Correlation of Polymorphisms with Phenotypic Traits

The polymorphisms of the invention may contribute to the phenotype of an organism in different ways. Some polymorphisms occur within a protein coding sequence and contribute to phenotype by affecting protein structure. The effect may be neutral, beneficial or detrimental, or both beneficial and detrimental, depending on the circumstances. For example, a heterozygous sickle cell mutation confers resistance to malaria, but a homozygous sickle cell mutation is usually lethal. Other polymorphisms occur in noncoding regions but may exert phenotypic effects indirectly via influence on replication, transcription, and translation. A single polymorphism may affect more than one phenotypic trait. Likewise, a single phenotypic trait may be affected by polymorphisms in different genes. Further, some polymorphisms predispose an individual to a distinct mutation that is causally related to a certain phenotype. For example, the polymorphisms identified herein and shown in Table 3 are present in the chromosomal loci which have been identified as described herein as conferring susceptibility to IBD such as CD and UC.

Correlation is performed for a population of individuals who have been tested for the presence or absence of a phenotypic trait of interest and for polymorphic markers sets. To perform such analysis, the presence or absence of a set of polymorphisms (i.e. a polymorphic set) is determined for a set of the individuals, some of whom exhibit a particular trait, and some of which exhibit lack of the trait. The alleles of each polymorphism of the set are then reviewed to determine whether the presence or absence of a particular allele is associated with the trait of interest. Correlation can be performed by standard statistical methods such as a K-squared test and statistically significant correlations between polymorphic form(s) and phenotypic characteristics are noted. For example, it might be found that the presence of allele A1 at polymorphism A correlates with heart disease. As a further example, it might be found that the combined presence of allele A1 at polymorphism A and allele B1 at polymorphism B correlates with increased susceptibility to IBD (e.g., CD and UC).0

Such correlations can be exploited in several ways. In the case of a strong correlation between a set of one or more polymorphic forms and a disease for which treatment is available, detection of the polymorphic form set in a human or animal patient may justify immediate administration of treatment, or at least the institution of regular monitoring of the patient. Detection of a polymorphic form correlated with serious disease in a couple contemplating a family may also be valuable to the couple in their reproductive decisions. For example, the female partner might elect to undergo in vitro fertilization to avoid the possibility of transmitting such a polymorphism from her husband to her offspring. In the case of a weaker, but still statistically significant correlation between a polymorphic set and human disease, immediate therapeutic intervention or monitoring may not be justified. Nevertheless, the patient can be motivated to begin simple life-style changes (e.g., diet, exercise) that can be accomplished at little cost to the patient but confer potential benefits in reducing the risk of conditions to which the patient may have increased susceptibility by virtue of variant alleles. Identification of a polymorphic set in a patient correlated with enhanced receptiveness to one of several treatment regimes for a disease indicates that this treatment regime should be followed.

For animals and plants, correlations between characteristics and phenotype are useful for breeding for desired characteristics. For example, Beitz et al., U.S. Pat. No. 5,292,639 discuss use of bovine mitochondrial polymorphisms in a breeding program to improve milk production in cows. To evaluate the effect of mtDNA D-loop sequence polymorphism on milk production, each cow was assigned a value of 1 if variant or 0 if wildtype with respect to a prototypical mitochondrial DNA sequence at each of 17 locations considered. Each production trait was analyzed individually with the following animal model:

$$Y_{ijkpn}=\mu YS_i+P_j+X_k+\beta_1+\ldots \beta_{17}+PE_n+a_n+e_p$$

where $Y_{ijknp}$ is the milk, fat, fat percentage, SNF, SNF percentage, energy concentration, or lactation energy record; $\mu$ is an overall mean; $YS_i$ is the effect common to all cows calving in year-season; $X_k$ is the effect common to cows in either the high or average selection line; $\beta_1$ to $\beta_{17}$ are the binomial regressions of production record on mtDNA D-loop sequence polymorphisms; $PE_n$ is permanent environmental effect common to all records of cow n; $a_n$ is effect of animal n and is composed of the additive genetic contribution of sire and dam breeding values and a Mendelian sampling effect; and $e_p$ is a random residual. It was found that eleven of seventeen polymorphisms tested influenced at least one production trait. Bovines having the best polymorphic forms for milk production at these eleven loci are used as parents for breeding the next generation of the herd.

D. Genetic Mapping of Phenotypic Traits

The previous section concerns identifying correlations between phenotypic traits (e.g., IBD) and polymorphisms that directly or indirectly contribute to those traits, such as those identified in Table 3. The present section describes identification of a physical linkage between a genetic locus associated with a trait of interest and polymorphic markers that are not associated with the trait, but are in physical proximity with the genetic locus responsible for the trait and co-segregate with it. Such analysis is useful for mapping a genetic locus associated with a phenotypic trait to a chromosomal position, and thereby cloning gene(s) responsible for the trait. See Lander et al., *Proc. Natl. Acad. Sci.* (USA) 83, 7353–7357 (1986); Lander et al., *Proc. Natl. Acad. Sci.* (USA) 84, 2363–2367 (1987); Donis-Keller et al., *Cell* 51, 319–337 (1987); Lander et al., *Genetics* 121, 185–199 (1989)). Genes localized by linkage can be cloned by a process known as directional cloning. See Wainwright, Med. J Australia 159, 170–174 (1993); Collins, Nature Genetics 1, 3–6 (1992).

Linkage studies are typically performed on members of a family. Available members of the family are characterized for the presence or absence of a phenotypic trait and for a set of polymorphic markers. The distribution of polymorphic markers in an informative meiosis is then analyzed to determine which polymorphic markers co-segregate with a phenotypic trait. See, e.g., Kerem et al., *Science* 245, 1073–1080 (1989); Monaco et al., *Nature* 316, 842 (1985); Yamoka et al., *Neurology* 40, 222–226 (1990); Rossiter et al., *FASEB Journal* 5, 21–27 (1991).

Linkage is analyzed by calculation of LOD (log of the odds) values. A lod value is the relative likelihood of obtaining observed segregation data for a marker and a genetic locus when the two are located at a recombination fraction 0, versus the situation in which the two are not linked, and thus segregating independently (Thompson &

Thompson, Genetics in Medicine (5th ed, W. B. Saunders Company, Philadelphia, 1991); Strachan, "Mapping the human genome" in The Human Genome (B[OS Scientific Publishers Ltd, Oxford), Chapter 4). A series of likelihood ratios are calculated at various recombination fractions (θ), ranging from θ=0.0 (coincident loci) to θ=0.50(unlinked). Thus, the likelihood at a given value of θ is: probability of data if loci linked at θ to probability of data if loci unlinked. The computed likelihoods are usually expressed as the $\log_{10}$ of this ratio (i.e., a lod score). For example, a lod score of 3 indicates 1000:1 odds against an apparent observed linkage being a coincidence. The use of logarithms allows data collected from different families to be combined by simple addition. Computer programs are available for the calculation of lod scores for differing values of θ (e.g., LIPED, MLINK (Lathrop, *Proc. Nat. Acad. Sci. (USA)* 81, 3443–3446 (1984)). For any particular lod score, a recombination fraction may be determined from mathematical tables. See Smith et al., *Mathematical tablesfor research workers in human genetics* (Churchill, London, 1961); Smith, Ann. Hum. Genet. 32, 127–150 (1968). The value of θ at which the lod score is the highest is considered to be the best estimate of the recombination fraction.

Positive lod score values suggest that the two loci are linked, whereas negative values suggest that linkage is less likely (at that value of θ) than the possibility that the two loci are unlinked. By convention, a combined lod score of +3 or greater (equivalent to greater than 1000:1 odds in favor of linkage) is considered definitive evidence that two loci are linked. Similarly, by convention, a negative lod score of −2 or less is taken as definitive evidence against linkage of the two loci being compared. Negative linkage data are useful in excluding a chromosome or a segment thereof from consideration. The search focuses on the remaining non-excluded chromosomal locations.

IV. Modified Polypeptides and Gene Sequences

The invention further provides variant forms of nucleic acids and corresponding proteins. The nucleic acids comprise one of the sequences described in Table 3, in which the polymorphic position is occupied by one of the alternative bases for that position. Some nucleic acids encode full-length variant forms of proteins. Similarly, variant proteins have the prototypical amino acid sequences encoded by nucleic acid sequences shown in Table 3, (read so as to be in-frame with the full-length coding sequence of which it is a component) except at an amino acid encoded by a codon including one of the polymorphic positions shown in Table 3. That position is occupied by the amino acid coded by the corresponding codon in any of the alternative forms shown in Table 3.

Variant genes can be expressed in an expression vector in which a variant gene is operably linked to a native or other promoter. Usually, the promoter is a eukaryotic promoter for expression in a mammalian cell. The transcription regulation sequences typically include a heterologous promoter and optionally an enhancer which is recognized by the host: The selection of an appropriate promoter, for example trp, lac, phage promoters, glycolytic enzyme promoters and tRNA promoters, depends on the host selected. Commercially available expression vectors can be used. Vectors can include host-recognized replication systems, amplifiable genes, selectable markers, host sequences useful for insertion into the host genome, and the like.

The means of introducing the expression construct into a host cell varies depending upon the particular construction and the target host. Suitable means include fusion, conjugation, transfection, transduction, electroporation or injection, as described in Sambrook, supra. A wide variety of host cells can be employed for expression of the variant gene, both prokaryotic and eukaryotic. Suitable host cells include bacteria such as *E. coli*, yeast, filamentous fungi, insect cells, mammalian cells, typically immortalized, e.g., mouse, CHO, human and monkey cell lines and derivatives thereof. Preferred host cells are able to process the variant gene product to produce an appropriate mature polypeptide. Processing includes glycosylation, ubiquitination, disulfide bond formation, general post-translational modification, and the like. As used herein, "gene product" includes mRNA, peptide and protein products.

The protein may be isolated by conventional means of protein biochemistry and purification to obtain a substantially pure product, i.e., 80, 95 or 99% free of cell component contaminants, as described in Jacoby, Methods in Enzymology Volume 104, Academic Press, New York (1984); Scopes, Protein Purification, Principles and Practice, 2nd Edition, Springer-Verlag, New York (1987); and Deutscher (ed), Guide to Protein Purification, Methods in Enzymology, Vol. 182 (1990). If the protein is secreted, it can be isolated from the supernatant in which the host cell is grown. If not secreted, the protein can be isolated from a lysate of the host cells.

The invention further provides transgenic nonhuman animals capable of expressing an exogenous variant gene and/or having one or both alleles of an endogenous variant gene inactivated. Expression of an exogenous variant gene is usually achieved by operably linking the gene to a promoter and optionally an enhancer, and microinjecting the construct into a zygote. See Hogan et al., "Manipulating the Mouse Embryo, A Laboratory Manual," Cold Spring Harbor Laboratory. Inactivation of endogenous variant genes can be achieved by forming a transgene in which a cloned variant gene is inactivated by insertion of a positive selection marker. See Capecchi, Science 244, 1288–1292 (1989). The transgene is then introduced into an embryonic stem cell, where it undergoes homologous recombination with an endogenous variant gene. Mice and other rodents are preferred animals. Such animals provide useful drug screening systems.

In addition to substantially full-length polypeptides expressed by variant genes, the present invention includes biologically active fragments of the polypeptides, or analogs thereof, including organic molecules which simulate the interactions of the peptides. Biologically active fragments include any portion of the full-length polypeptide which confers a biological function on the variant gene product, including ligand binding, and antibody binding. Ligand binding includes binding by nucleic acids, proteins or polypeptides, small biologically active molecules, or large cellular structures.

Polyclonal and/or monoclonal antibodies that specifically bind to variant gene products but not to corresponding prototypical gene products are also provided. Antibodies can be made by injecting mice or other animals with the variant gene product or synthetic peptide fragments thereof. Monoclonal antibodies are screened as are described, for example, in Harlow & Lane, Antibodies, A Laboratory Manual, Cold Spring Harbor Press, New York (1988); Goding, Monoclonal antibodies, Principles and Practice (2d ed.) Academic Press, New York (1986). Monoclonal antibodies are tested for specific immunoreactivity with a variant gene product and lack of immunoreactivity to the corresponding prototypical gene product. These antibodies are useful in diagnostic assays for detection of the variant form, or as an active ingredient in a pharmaceutical composition.

V. Kits

The invention further provides kits comprising at least one allele-specific oligonucleotide as described herein. Often, the kits contain one or more pairs of allele-specific oligonucleotides hybridizing to different forms of a polymorphism. In some kits, the allele-specific oligonucleotides are provided immobilized to a substrate. For example, the same substrate can comprise allele-specific oligonucleotide probes for detecting at least 10, 100 or all of the polymorphisms shown in Table 3. Optional additional components of the kit include, for example, restriction enzymes, reverse-transcriptase or polymerase, the substrate nucleoside triphosphates, means used to label (for example, an avidin-enzyme conjugate and enzyme substrate and chromogen if the label is biotin), and the appropriate buffers for reverse transcription, PCR, or hybridization reactions. Usually, the kit also contains instructions for carrying out the methods.

The following Examples are offered for the purpose of illustrating the present invention and are not to be construed to limit the scope of this invention. The teachings of all references cited herein are hereby incorporated herein by reference.

EXAMPLES

With the goal of identifying IBD susceptibility genes, a genomewide scan was undertaken in 163 pedigrees, and three regions of suggestive linkage (3, 5q31–33, 9p) and one of significant linkage to 19p13 (LOD=4.6) were identified. Higher density mapping in the suggestive 5q31–33 region revealed a CD susceptibility locus of genome-wide significance (LOD=3.9). Importantly, the 5q3]–p33 localizes to the major immunoregulatory cytokine gene cluster and the 19p13 locus to a region containing numerous genes encoding cytokine/chemokine receptors and other inflammatory-associated molecules that could have a direct role in disease susceptibility.

In order to pursue the evidence of linkage to chromosome 5, a systematic linkage disequilibrium (LD) approach was adopted. The approach that was used in the first stage of LD mapping was to genotype all known microsatellite markers in the 18 cM between D5S1435 and D5S1480, as these two markers delimit a region of a 2 LOD drop on either side of the linkage peak centered at marker D5S2497. All alleles for each marker were examined for evidence of excess transmission from heterozygous parents to CD child using the transmission disequilibrium test (TDT). Only alleles at two of the 57 markers had significant $C^2$ results (p<0.001): IRF9p1 ($C^2$=13.3, p=0.0003) and D5S1984 ($C^2$=14.0, p=0.0002) (Table 1). A second stage of mapping was then undertaken to confirm, as well as to better delimit, the region of LD surrounding IRF9p1 and D5S1984. The development of new microsatellite markers was necessary. The marker with the most significant $C^2$ result was CAh16a ($C^2$=16.2, p=0.00006) and was located between IRF9p1 and D5S1984 (Table 2). Furthermore, the alleles 193, 156, 373, 140, 222, and 307 at markers GAh16a, IRF9p, CAh16a, CAh16a, D5S1984, CSF9p10, respectively, define a haplotype conferring susceptibility to Crohn's disease (CD). In order to identify the sequence variant that would explain the genetic susceptibility to CD provided by this haplotype, a search was performed for all single nucleotide polymorphisms (SNPs) in this region of LD. The SNP discovery was accomplished by direct sequencing of overlapping PCR products amplified from DNA samples from eight individuals (six CD patients, one unaffected family member, and one CEPH DNA as control). Table 3 shows the results of the SNP discovery analyses. 139 triads were genotyped for a total of 241 SNPs thus far, where at least 50 trios were fully genotyped. Using a $C^2$ value of 13 (corresponding to a p-value of 0.05) as threshold, 12 SNPs were found to have a significant level of association with CD and extended over a region of 250 kb, from IRF1 to prolyl4 hydroxylase. These were markers IGR2056a_1, IGR2060a_1, IGR2063b_1, IGR2066a_2, IGR2076a_1, IGR2096a I, IGR2196a_1, IGR2230a_1, IGR2276a_1, IGR3086a_1, IGR3096a_1, PROLYLex3_1 (see Table 4). Any of these best SNPs by themselves are in strong association with CD and fully explain the microsatellite LD observations. Furthermore, the best SNPs have nearly identical association characteristics (that is, the allele at one SNP determines the allele of all others on any phased chromosome), confirming that a single risk haplotype extending approximately 250 kb is the source of all the observations of association in this region. Specifically, this haplotype is defined by the alleles G, C, G, T, A, A, G, T, G, G, C, T at markers IGR2056a_1, IGR2060a_1, IGR2063b_1, IGR2066a_2, IGR2076a_1, IGR2096a_1, IGR2196a_1, IGR2230a_1, IGR2276a_1, IGR3086a_1, IGR3096a_1, PROLYLex3_1, respectively. The frequency of this haplotype is estimated to be approximately 37% in the general population. Furthermore, this haplotype is transmitted from heterozygous parents to CD patients at a ratio of 2.5:1.

Families

For the linkage study, multicase families with 2 or more siblings affected by IBD were identified by review of clinical charts of all patients registered in the Mount Sinai Hospital Inflammatory Bowel Disease Unit patient database and from the Hospital for Sick Children IBD database. Patients were also referred by physicians in the Greater Toronto Area (GTA). To confirm and update information obtained from these records, all patients were sent a questionnaire inquiring about the presence of a family history of IBD. Individuals identified as having other affected first-degree relatives were invited to participate and asked for permission to contact other affected and unaffected family members. Endoscopic, histological and radiological reports as well as clinical data were obtained on all affected individuals and these reports were reviewed for verification of diagnosis based upon standard criteria. Venous blood sampling was performed on affected individuals and their parents, and DNA was extracted using a salting out procedure. Ethics approval for this study was given by the University of Toronto Ethics Committee and written informed consent was obtained from all participants.

All of the LD analyses in this study were performed with father-mother-affected child (CD only) triads, where 0 or 1 of the parents was affected with CD. These triads either came from the multicase families used in the linkage stage of this study or were identified specifically for the purpose of the LD study. Specifically, for the microsatellite genotyping, 296 triads were genotyped: 95 of these triads were derived from families used in the original identification of the IBD5 locus (only one triad per family), and 201 were from newly collected families. For the SNP genotyping, 139 triads were genotyped: 18 were derived from families used in the original identification of the IBD5 locus, and 121 were from the newly collected families. Individuals affected by CD were identified by review of the clinical charts of all patients registered in the Mount Sinai Hospital Inflammatory Bowel Disease Centre patient database and from the Toronto Hospital for Sick Children IBD database. Written informed consent was obtained from all participants and ethics approval for this study was granted by the University of Toronto Ethics Committee.

Microsatellite Genotyping

Genomic DNA was extracted from peripheral blood lymphocytes from probands and family members from 163 Caucasian pedigrees. The genome-wide scan, with an average inter-marker spacing of 12 cM, was carried out using a modified version of the Cooperative Human Linkage Centre (CHLC) Screening Set/version 6.0 that also included Genethon markers. These 312 loci were amplified using fluorescently-labeled primers (Research Genetics Inc., Huntsville Ala.) in separate polymerase chain reactions, and the products were then multiplexed into panels by pooling before electrophoresis on ABI 377 sequencers (PE Applied Biosystems, Foster City, Calif.). Fluorescent genotyping gels were analyzed in an automated system developed at the Whitehead Institute/MIT Center for Genome Research. Further details of the genotyping system have previously been described (Rioux et al., *Gastroenterology* 115:1062–1065 (1998)).

The region of suggestive linkage on chromosome 5 and the surrounding regions of poor information content were followed up with 34 additional microsatellite markers. Specifically, 34 markers were genotyped between markers D5S1470 and D5S1471, decreasing the average spacing between markers to approximately 3 cM in this 125 cM region. This higher density mapping was performed on the original samples and on additional 12 families, for a total of 175 pedigrees analyzed. These new families consisted of 16 CD affected sibpairs.

In the first phase of the microsatellite LD mapping, a total of 57 microsatellite markers were genotyped on 296 CD triads. Information regarding primer sequence, allele size range, and suggested amplification conditions for 55 of these genetic markers (all but IRF9p1 and CSF9p10) can be obtained from the Genethon (on the World Wide Web at genethon.fr), Marshfield (on the World Wide Web at research.marshfieldclinic.org/genetics/), or Genome Database (on the World Wide Web at genethon.fr). The markers IRF9p1, CSF9p1, and the 8 markers used in the 2nd stage of LD mapping, were designed during the course of this study. Genotypes for all of these markers were obtained as described above.

SNP Discovery

In order to identify all SNPs in the IBD5 critical region, a tiling path of overlapping PCR roducts was designed. Specifically, PCR assays were designed using Primer 3.0 to be approximately 700 bp in length, with 100 bp overlap with adjacent assays. The −21 M13 forward and the −28 M13 reverse sequences were added to each of the forward and reverse PCR primers, respectively. These PCR primers were used to amplify 50 ng of genomic DNA from six CD patients, one unaffected family member, and one CEPH DNA as control. The PCR products were purified using the solid phase reversible immobilization (SPRI) method and then sequenced using the appropriate −21 M13 or −28 M13 DYEnamic Direct Cycle Sequencing kit (Amersham Pharmacia Biotech Ltd, Cleveland, Ohio). All sequencing reactions were run on ABI377 automated sequencers (PE Applied BioSystems, Foster City, Calif.); the gel files were processed using the BASS software, available on the Whitehead Institute/MIT Center for Genome Research FTP site. Sequences were base-called by the Phred program, and then the forward and reverse reads were assembled by the Phrap program. All traces were visually inspected by at least two observers.

SNP genotyping

SNP genotyping was performed using length-multiplexed single-base extension (LM-SBE) as previously described. Briefly, PCR primers were designed as close as possible to the SNPs identified in the current study, resulting in a product of a maximum length of 150 bp. Forward primers had T7 tails at their 5' ends and reverse primers had T3 tails at their 5' ends. These T7 and T3 tails were used for secondary amplification. Primer pairs were checked for homology to all amplicons and sorted into pools consisting of up to 50 primer pairs. Loci were subjected to two rounds of PCR amplification. In the first round, 10 ng of genomic DNA was amplified using a pool of primer pairs (0.1 mM) and 2.5 units of Amplitaq Gold (Perkin Elmer). In the second round, a 3 mL aliquot of the primary amplification product was amplified with biotinylated-T7 and biotinylated-T3 primers. A 7 mL aliquot of this secondary amplification product was purified from the unincorporated dNTPs using streptavidin-coated Dynabeads (Dynal). A multiplex SBE reaction was then carried out on the purified product using SNP-specific primers, JOE-ddATP (0.12 M),TAMRA-ddCTP (0.12 M), FAM-ddGTP (0.12 M),ROXddUTP (0.60 M; NEN DuPont) and Thermosequenase (0.5 U; Amersham). Excess ddNTPs were removed from the SBE products using 96-well gel filtration blocks (Edge Biosystems) prior to electrophoresis on ABI 377 sequencers. The SBE gels were analyzed using a system developed at the Whitehead Institute/MIT Center for Genome Research as previously described.

Statistical analysis

Nonparametric multipoint linkage analysis of the data from the genome-wide scan and the higher density mapping on chromosome 5 was performed using the MAPMAKER/SIBS functions implemented in GENHUNTER 2.0. It is important to note that all sib pairs from sibships with more than 2 affecteds were counted but were conservatively downweighted by a factor of 2/n (where n=the number of affecteds). Exclusion mapping was also performed with this software package, and a locus 8s>2 was considered excluded at a LOD score of −2.

To establish appropriate thresholds for suggestive and significant genome-wide linkage for these particular datasets, simulations were performed by generating artificial genotype data with the identical family structures. These simulations matched the datasets with respect to marker density, marker informativeness, the individuals genotyped, affected status, and the fraction of missing data.

To assess the significance of the TDT results for each marker, permutation tests using the same genotype data were carried out. For each trio, chromosomes were randomly reassigned as transmitted or untransmitted to form a permuted dataset. The number of permuted datasets with values as significant as that seen for the best single-marker and two-marker tests were tabulated. In order to quantify the extent of LD in the IBD5 region, 3-marker haplotypes were examined using the TDT and $P_{excess}$ (d). $P_{excess}$ represents the strength of LD and is calculated by $(P_{affected} - P_{normal})/(1 - P_{normal})$ In our study, the $P_{affected}$ is calculated from the frequency of the haplotype among the transmitted parental chromosomes and $P_{normal}$ is the frequency among untransmitted parental chromosomes.

TABLE 1

Summary of the first stage of LD mapping using microsatellite markers.

| Marker # | Marker Name | Source of marker[1] | Estimated Genetic Position[2] | Distance to next marker | Previous linkage results (MLOD)[3] | TDT results[4] | | |
|---|---|---|---|---|---|---|---|---|
| | | | | | | Allele | X² | pvalue |
| 1 | D5S1435 | G | 128.50 | 0.50 | 0.76 | 115 | 5.84 | 0.016 |
| 2 | AFMa113ye9 | G | 129.00 | 0.83 | | — | — | — |
| 3 | D5S1505 | M | 129.83 | 0.00 | 0.79 | — | — | — |

TABLE 1-continued

Summary of the first stage of LD mapping using microsatellite markers.

| Marker # | Marker Name | Source of marker[1] | Estimated Genetic Position[2] | Distance to next marker | Previous linkage results (MLOD)[3] | TDT results[4] Allele | TDT results[4] $X^2$ | TDT results[4] pvalue |
|---|---|---|---|---|---|---|---|---|
| 4 | D5S1384 | U | 129.83 | 0.00 | — | — | — | — |
| 5 | D5S471 | G | 129.83 | 0.57 | 0.79 | 238 | 7.58 | 0.0059 |
| 6 | D5S632 | G | 130.40 | 0.20 | | 114 | 4.59 | 0.032 |
| 7 | D5S818 | M | 130.60 | 0.20 | | — | — | — |
| 8 | D5S2502 | M | 130.80 | 0.10 | | — | — | — |
| 9 | AFMB352XH5 | G | 130.90 | 0.04 | | — | — | — |
| 10 | D5S1975 | G | 130.94 | 0.00 | | — | — | — |
| 11 | D5S622 | G | 130.94 | 1.86 | | — | — | — |
| 12 | D5S2059 | G | 132.80 | 0.85 | | 190 | 5.83 | 0.016 |
| 13 | D5S615 | U | 133.65 | 0.00 | 1.8 | — | — | — |
| 14 | D5S804 | M | 133.65 | 0.00 | 1.8 | — | — | — |
| 15 | D5S1495 | M | 133.65 | 0.00 | 1.8 | 382 | 4.00 | 0.045 |
| 16 | GATA68A03 | M | 133.65 | 0.35 | 2.2 | — | — | — |
| 17 | D5S809 | M | 134.00 | 0.40 | 2.1 | — | — | — |
| 18 | D5S2120 | G | 134.40 | 0.20 | | — | — | — |
| 19 | D5S642 | G | 134.60 | 0.65 | 2.6 | — | — | — |
| 20 | D5S2057 | G | 135.25 | 0.00 | 3.1 | — | — | — |
| 21 | D5S2110 | G | 135.25 | 0.62 | 3.1 | — | — | — |
| 22 | IRF1p1 | S | 135.87 | 0.19 | | 156 | 13.27 | 0.00027 |
| 23 | D5S1984 | G | 136.06 | 0.16 | | 222 | 14.04 | 0.00018 |
| 24 | CSF2p10 | S | 136.22 | 0.58 | | 307 | 4.00 | 0.045 |
| 25 | D5S2497 | G | 136.80 | 0.10 | 3.9 | 129 | 7.69 | 0.0055 |
| 26 | w2429/240wa7 | G | 136.90 | 0.10 | | — | — | — |
| 27 | w866/057vg5 | G | 137.00 | 0.10 | | — | — | — |
| 28 | D5S1766 | U | 137.10 | 0.10 | 3.5 | 245 | 6.48 | 0.011 |
| 29 | D5S808 | M | 137.20 | 0.10 | 3.3 | — | — | — |
| 30 | D5S458 | G | 137.30 | 0.00 | 3.1 | — | — | — |
| 31 | D5S396 | G | 137.30 | 0.09 | | — | — | — |
| 32 | D5S2053 | G | 137.39 | 0.56 | 3.0 | — | — | — |
| 33 | D5S1995 | G | 137.95 | 0.69 | 2.8 | — | — | — |
| 34 | D5S2115 | G | 138.64 | 0.68 | 2.4 | — | — | — |
| 35 | IL9 | M | 139.32 | 0.01 | 2.0 | — | — | — |
| 36 | D5S816 | M | 139.33 | 0.07 | 2.0 | — | — | — |
| 37 | D5S393 | G | 139.40 | 0.10 | 2.0 | — | — | — |
| 38 | D5S399 | G | 139.50 | 0.90 | 2.0 | 127 | 4.57 | 0.032 |
| 39 | D5S479 | G | 140.40 | 0.10 | | — | — | — |
| 40 | AFM350yb1 | G | 140.50 | 0.10 | | — | — | — |
| 41 | D5S1983 | G | 140.60 | 0.12 | | 116 | 4.55 | 0.033 |
| 42 | D5S476 | G | 140.72 | 0.00 | 1.7 | — | — | — |
| 43 | D5S500 | G | 140.72 | 0.28 | 1.7 | 211 | 4.15 | 0.042 |
| 44 | AFMB290YC9 | G | 141.00 | 0.82 | | — | — | — |
| 45 | D5S414 | G | 141.82 | 0.98 | | — | — | — |
| 46 | D5S2009 | G | 142.80 | 0.12 | | 140 | 6.70 | 0.01 |
| 47 | D5S658 | G | 142.92 | 0.00 | 2.0 | — | — | — |
| 48 | D5S2116 | G | 142.92 | 1.08 | | — | — | — |
| 49 | D5S2011 | G | 144.00 | 0.06 | | — | — | — |
| 50 | D5S2119 | G | 144.06 | 0.00 | | — | — | — |
| 51 | D5S1979 | G | 144.06 | 1.15 | | — | — | — |
| 52 | D5S2017 | G | 145.21 | 2.19 | 2.2 | 91 | 5.40 | 0.02 |
| 53 | D5S2859 | M | 147.40 | 0.09 | | — | — | — |
| 54 | D5S436 | G | 147.49 | 0.00 | 1.6 | — | — | — |
| 55 | D5S207 | M | 147.49 | 0.00 | | — | — | — |
| 56 | D5S1480 | M | 147.49 | | 1.6 | — | — | — |

[1]Abbreviations: G, Genethon; M, Marshfield; U, Utah; S, designed by authors from genomic sequence.
[2]Estimated from genetic (Genethon, Marshfield) and physical (data not shown) map information
[3]Linkage data for the CD subgroup with early onset disease as seen in FIG. 1 and reference ###
[4]Results are shown only if pvalue < 0.05

TABLE 2

Summary of combined LD mapping information.

| Marker # | Marker Name | Distance to next marker (kb) | LD mapping stage | Allele | T:U | X² | pvalue |
|---|---|---|---|---|---|---|---|
| 57 | CAh14b | 43 | 2 | — | — | — | |
| 58 | ATTh14c | 167 | 2 | — | — | — | |
| 59 | IL4m2 | 164 | 2 | 214 | 1.8 | 4.74 | 0.029 |
| 60 | GAh18a | 21 | 2 | 193 | 1.4 | | 0.018 |
| 22 | IRF1p1 | 24 | 1 | 156 | 1.7 | 13.27 | 0.00027 |
| 61 | CAh15a | 130 | 2 | 373 | 1.5 | 7.73 | 0.0054 |
| 62 | CAh17a | 97 | 2 | 140 | 1.8 | 16.19 | 0.000057 |
| 23 | D5S1984 | 163 | 1 | 222 | 1.8 | 14.04 | 0.00018 |
| 24 | CSF2p10 | 178 | 1 | 307 | 1.4 | 4.00 | 0.045 |
| 63 | CAh81b | 85 | 2 | — | — | — | |
| 64 | CAh81c | | 2 | — | — | — | |

TABLE 3

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 1 | CSF2_6610 | c/t | | Verified | gene | n/a | colony stimulating factor 2 | aaacttcctgtgcaacccagaNtatcacctttgaaa gtttcaaag |
| 2 | CSFenh_1492 | g/t | | Verified | gene | n/a | colony stimulating factor 2 (enhancer | atttccttcccttgtgataatgtctctcgtNtaaggaa tcctggagtgactcaagc |
| 3 | CSFenh_1580 | g/t | | Verified | gene | n/a | colony stimulating factor 2 (enhancer | acacgcataggaaactccttccagagggttttcNc ctgtctctgtaggaaggggggccccagaggg |
| 4 | CSFex4_6632 | c/t | | Verified | gene | n/a | colony stimulating factor 2 | aaaggaaacttcctgtgcaacccagaNtatcacct ttgaaagtttcaaagaga |
| 5 | E4ex1_1 | t/c | | Verified | EST | n/a | n/a | ctgggaacccaaacatcctggaaaNagctgag aacctaccaaggga |
| 6 | E4ex1_2 | a/g | | Verified | EST | n/a | n/a | agacagaaaattagcttagagatgggaggtggca Ngatctctaaagctgtcccgctgcc |
| 7 | E4ex1_3 | t/c | | Verified | EST | n/a | n/a | atgggaggtggcac-gatctctaaagctgtccNgctgccattcaggagtgc ctcatgcataag |
| 8 | Facoex16_1 | g/c | | Verified | gene | n/a | Fatty acid CoA ligase | ggctactttgaaagatccagacaggaNgaaggag gccctggacagcgatggc |
| 9 | FaCoex1_1 | t/c | | Verified | gene | n/a | Fatty acid CoA ligase | accagggagctgtgctaccactgctaaNggctct accaccaccggcttctc |
| 10 | GENS010ex2_1 | t/c | | Verified | Predicted gene | n/a | | agaagcagtagggcNactactaggtagcccca |
| 11 | GENS020ex1_1 | a/g | | Verified | Predicted gene | n/a | | gggtgtgacagaggctgtNtggcaggactc |
| 12 | GENS020ex3_1 | a/c | | Verified | Predicted gene | n/a | | ggcgcccacNcaaactctgtcgcagtcc |
| 13 | GENS020ex3_2 | t/g | | Verified | Predicted gene | n/a | | aggcccagccctNttccttactatgtcct |
| 14 | GENS020ex3_3 | a/g | | Verified | Predicted gene | n/a | | tagaagcagaaggtggttgtggcctcNctggtgtg ggactttctgccccactgcac |
| 15 | GENS021ex1_1 | g/c | | Verified | Predicted gene | n/a | | tcatggcggggtgtctgtgacctgagagaggNtca gatggaagaagcctgggtgaggaatgag |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 16 | GENS021ex1_2 | t/c | | Verified | Predicted gene | n/a | | aaggccctcattgattcatgattaNgtggtttgttgttg tccatgcct |
| 17 | GENS025ex1_1 | a/g | | Verified | Predicted gene | n/a | | gctccaagccctggggagggaaggaagtggctg accccac |
| 18 | GENS026ex12_1 | a/t | | Verified | Predicted gene | n/a | | ctttcatgtagaaagagctagtagtacttgattNtata atgcttaccatgtccatatgaacaagcttcc |
| 19 | GENS026ex3_1 | t/c | | Verified | Predicted gene | n/a | | tccttcctcacaaactcctaagtacccNgagagca ataggactcctgttaaa |
| 20 | GENS026ex4_1 | t/c | | Verified | Predicted gene | n/a | | gggttttgtgtatctaaaataggNgacctcagcctta aaacctcatct |
| 21 | GENS026ex5_1 | t/c | | Verified | Predicted gene | n/a | | tggaaaaatcaattaccccctgtattacNtgtgtgga gaaatgaaggcatt |
| 22 | GENS026ex5_2 | a/g | | Verified | Predicted gene | n/a | | cagtaaatatytaggcctatgtc |
| 23 | GENS026ex6_1 | t/g | | Verified | Predicted gene | n/a | | aatttatttatttgcttttaaataagtgaNctct-ctgctcatttggattctgctatctcgta |
| 24 | GENS026ex6_2 | t/c | | Verified | Predicted gene | n/a | | ttatttatttgcttttaaataagtga-ctctNctgctcatttggattctgctatctcgta |
| 25 | GENS027ex2_1 | a/g | | Verified | Predicted gene | n/a | | gcaatgctgttttttctttagtatacaaaNtgaatcctt ctttccctcaaaagcttga |
| 26 | GENS027pro_1 | a/c | | Verified | Predicted gene | n/a | | cccccaccatctctcggtgggcgaagggaNatg gtatctttaataccaaaagataat |
| 27 | GENS027pro_2 | t/c | | Verified | Predicted gene | n/a | | atctttgaggctttatgaaccacatatggtNgaaaa cattgttggcctctggcacaga |
| 28 | GENS02ex2_1 | a/g | | Verified | Predicted gene | n/a | | ccatctatgtaggtaacNgaggcaaagcaaggg ctagggaga |
| 29 | GENS02ex3_1 | g/c | | Verified | Predicted gene | n/a | | gggaggcagacattaggcaaataatNacatggat ctctgaaaaacatagctcctacga |
| 30 | GENS02ex4_1 | t/g | | Verified | Predicted gene | n/a | | agaggaatggggtggagttggcagNggggctggt tctcggctctccccga |
| 31 | GENS030ex2_1 | a/g | | Verified | Predicted gene | n/a | | ctggcttaggccaaagaactggccaNgttacagtt cccacagagtacccg |
| 32 | GENS030ex3_1 | a/t | | Verified | Predicted gene | n/a | | agggtgagtgaggtgtactagggaNtctggacact gagcccctgaagttgggg |
| 33 | GENS030ex4_1 | a/g | | Verified | Predicted gene | n/a | | gcggctgcaggggggaggcacaagcNtgggcca ggcgccaagcggc |
| 34 | GENS030pro_1 | t/c | | Verified | Predicted gene | n/a | | atgtgctaccatggccaactaatgtttga |
| 35 | GENS031ex1_1 | t/c | | Verified | Predicted gene | n/a | | ctgggtaaaacaggctgccctggacaaagcNgg aaacagaatgaggctccaggcgttgatt |
| 36 | GENS031pro_1 | a/t | | Verified | Predicted gene | n/a | | ccacattttcttaatccagtctatcattgNtggacattt gggttggttccaagtctttgc |
| 37 | GENS036ex1_1 | t/g | | Verified | Predicted gene | n/a | | tccttcacaggacaggaattctgcaaaaNaaacat ttcattagcttgcattggtaagcat |
| 38 | GENS036ex1_2 | t/c | | Verified | Predicted gene | n/a | | aaatggttactgtataccattacctatctgcttttNggg gtgggtggcgcggggggga |
| 39 | GENS037ex1_1 | a/g | | Verified | Predicted gene | n/a | | aataggtgtcgatttgcagtgacaatgtgagNcaat tagtttatcaggagaagctaacatg |
| 40 | GENS037pro_1 | a/c | | Verified | Predicted gene | n/a | | tgaactttagctctctttggtaaataggaaatNgctc caactacttgtccacccaagaaac |
| 41 | GENS038ex3_1 | a/c | | Verified | Predicted gene | n/a | | tatctgccgccctccccctccacagcttgtcagNcttc atctaattggaaaagccagatgctcg |
| 42 | GENS038pro_1 | t/c | | Verified | Predicted gene | n/a | | tcccctccccttgtttcgtcccgatctctgttcNcatctt atctcatggggaggatttctccaacct |
| 43 | GENS039ex4_1 | a/g | | Verified | Predicted gene | n/a | | ctctttgctaacatatttaatatttaaatacNaggaaa aacaataaattactcgttggctga |
| 44 | GENS039ex7_1 | a/g | | Verified | Predicted gene | n/a | | atgtcgccttttcctgctcttccctcNttttcctagaagt cctccagaaacc |
| 45 | GENS039ex7_2 | t/g | | Verified | Predicted gene | n/a | | ctggagtgccgctacttggccgtgtgaccccNctac gggcctgtttcctaatctgta |
| 46 | GENS03ex2_1 | a/g | | Verified | Predicted gene | n/a | | ataatgcagaacaaattagagaaaaactccNgtc aggctctccactcacccatgctggtggct |
| 47 | GENS03ex6_1 | a/g | | Verified | Predicted gene | n/a | | aaacaaacaatgcccggcagagtcaccNgggct ggcatttgaaaagagtacatcag |

TABLE 3-continued

Legend:
EST: expressed sequence tag
gene: known gene
Predicted gene: gene predicted from genomic sequence using the GENSCAN package
ins/del: insertion/deletion
genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 48 | GENS03ex6_2 | a/t | | Verified | Predicted gene | n/a | | gggagggctcctggaacccagagagaccNgtag gaggggactgccggcaggagctgtg |
| 49 | GENS043ex1_1 | a/g | | Verified | Predicted gene | n/a | | gcggcatctccatccttccaatgaacttgagcNtga gcaatgaacttgagtgtacagtctcat |
| 50 | GENS043ex2_1 | a/c | | Verified | Predicted gene | n/a | | tactttatcttcaattcgcagttggttgaaaaaNtctg caaatacgtagccctcccagttcaa |
| 51 | GENS044ex1_1 | t/c | | Verified | Predicted gene | n/a | | cagtagtgctaggaaagagatgtgattactgcNt ctgtgcaatgataaagcagtaagttatccg |
| 52 | GENS044ex2_1 | t/c | | Verified | Predicted gene | n/a | | tgtagtaaaaacattcaaaatcctctcttcNagctat caagttattttgtaatttg |
| 53 | GENS044ex2_2 | t/g | | Verified | Predicted gene | n/a | | ctaaactggggtcatatttcctcatcagccNcattct gctaatgccagatgccctgggaag |
| 54 | GENS044ex2_3 | a/c | | Verified | Predicted gene | n/a | | tctgctaatgccagatgccctgggaagNtcttcact gccatcttggaaggatgcaga |
| 55 | GENS044ex2_4 | t/c | | Verified | Predicted gene | n/a | | cctgggaagatcttcactgccatcNtggaaggatg cagaatgtgtgat |
| 56 | GENS044ex3_1 | a/g | | Verified | Predicted gene | n/a | | ctgctcccatcttccctataccatgtctgaNcccttga gccataacatggatggacagc |
| 57 | GENS045ex10_1 | g/c | | Verified | Predicted gene | n/a | | aagctacacaagatgggcatttggcctttNaccaa catgcttgttccttgactt |
| 58 | GENS045ex10_2 | t/c | | Verified | Predicted gene | n/a | | cagcaaacccatgcaaacattcagcatttcaNg gctgaggccacacacagaagccatcag |
| 59 | GENS045ex10_3 | a/g | | Verified | Predicted gene | n/a | | aaaccccatgcaaacattcagcatttcacNgctga ggcacacacagaagcc |
| 60 | GENS045ex10_4 | g/c | | Verified | Predicted gene | n/a | | ggtagcccacagatgtttctgtggctaccaacNga gaaaagccatcttttaaacagc |
| 61 | GENS045ex10_5 | t/c | | Verified | Predicted gene | n/a | | gccatcttttaaacagcagaaatctcactcgttcNc ctgtcccactctctccctgtcaatcccccaggac |
| 62 | GENS07ex1_1 | t/c | | Verified | Predicted gene | n/a | | ccatctgagacctcatcagccacgccttcacttcca Natcaccatcagcattctggttacaac |
| 63 | GENS09ex5_1 | t/g | | Verified | Predicted gene | n/a | | ggggcttgcgcagcactgggccNgggacgcaga cccaa |
| 64 | GENS09ex5_2 | a/g | | Verified | Predicted gene | n/a | | cagcactgggccggggacgcagacccaaNacg acagcaggcagcgccgagcg |
| 65 | GENS09pro_1 | t/c | | Verified | Predicted gene | n/a | | tggaaggggccgacatggcaatgaatcta |
| 66 | IGR1000a_1 | a/g | | Verified | genomic | 513 | | cccaggttggtttNgaactcctggctt |
| 67 | IGR1002a_1 | g/c | | Verified | genomic | 418 | | actgctgggccgNgtgtggtggct |
| 68 | IGR1002a_2 | t/c | | Verified | genomic | 422 | | gctgggccgggtgNggtggctcaccc |
| 69 | IGR1002a_3 | g/c | | Not yet verified | genomic | 477 | | aggcaggtggatcacNaggtcaagga |
| 70 | IGR1002a_4 | other/ Poly t w+ | | Verified | genomic | 259 | | gtaaaatttaNtttttttt |
| 71 | IGR1002a_5 | a/t | | Verified | genomic | 405 | | ttagaaaaacNactgctgggccg |
| 72 | IGR1003b_1 | a/c | | Verified | genomic | 210 | | ctcagaaaaacaaaacaNaacaaaaagaaac |
| 73 | IGR1003b_2 | other/ Poly t w+ | | Verified | genomic | 1 | | taaaaatttaaNttttttttttttt |
| 74 | IGR1004a_a | other/ Poly a w+ | | Verified | genomic | 395 | | aaaaaNaaacaacactttagag |
| 75 | IGR1006a_1 | t/g | | Verified | genomic | 389 | | aactcctgacctaaNgtgatccgcctgctt |
| 76 | IGR1006a_2 | ins/ del | | Verified | genomic | 169 | | gttttttttttNtttgagacagaa |
| 77 | IGR1007a_1 | t/c | | Verified | genomic | 190 | | tttcctttaccatNctgtcctcatat |
| 78 | IGR1007a_2 | t/c | | Verified | genomic | 196 | | ccatcctgtcNtcatatacaaact |
| 79 | IGR1008a_1 | other/ Poly t w+ | | Verified | genomic | 605 | | tggttgcttctacNttttttttt |
| 80 | IGR1008a_2 | t/c | | Verified | genomic | 385 | | tattttttgcctcNgtggattctcct |
| 81 | IGR1009a_1 | t/c | | Verified | genomic | 373 | | gtgctgggattaNaggtgtgaaccac |
| 82 | IGR1009a_2 | t/c | | Verified | genomic | 389 | | aggtgtgaaccactgNtcccagcccactc |
| 83 | IGR1010a_1 | other/ ca repeat w+ | | Verified | genomic | 186 | | ttcatttatgcacatNacacacacac |
| 84 | IGR1011a_1 | g/c | | Verified | genomic | 207 | | ttcatccactgtgNacagttgtattt |
| 85 | IGR1012a_1 | t/g | | Verified | genomic | 520 | | ggaattctgcaaaaNaaacatttcatta |
| 86 | IGR1012a_2 | t/c | | Verified | genomic | 556 | | ggtaagcatttgtcNtgcctgcctgt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 87 | IGR1013a_1 | t/c | | Verified | genomic | 247 | | accattacctatctgctttNggggtgggtggcgcgg |
| 88 | IGR1015a_1 | a/c | a in ref. sequence | Verified | genomic | 202 | | tccctccttgagtgtcctcaNcggcttcctggggtac |
| 89 | IGR1016a_1 | a/g | | Verified | genomic | 300 | | cacgccaccatcNtctctagcctggttt |
| 90 | IGR1016a_2 | ins/del | | Verified | genomic | 420 | | atcttgcttcNatgctttcccc |
| 91 | IGR1016a_3 | t/g | | Verified | genomic | 103 | | ccctacaaccNatctgtcag |
| 92 | IGR1017a_1 | t/c | | Verified | genomic | 537 | | aagggtgctgcagctccNaaggagtgtttagaa |
| 93 | IGR1019a_1 | t/c | | Verified | genomic | 366 | | gagcagcacatggNccaagtgaggagctaag |
| 94 | IGR1020a_1 | t/c | | Verified | genomic | 590 | | tcccaccagccagaggtaactaNtgctgttaatatt |
| 95 | IGR1021a_1 | t/g | | Verified | genomic | 237 | | ggtggtattagagaacaNgggattgagagctgc |
| 96 | IGR1021a_2 | g/c | | Verified | genomic | 314 | | gcagattttgNtctgtaaat |
| 97 | IGR1021a_3 | t/c | | Verified | genomic | 411 | | agttcatattttaaNgttttttcagg |
| 98 | IGR1021a_4 | ins/del | 2 bp deletion | Verified | genomic | 187 | | cttctttactctNtacatataccat |
| 99 | IGR1022a_1 | g/c | | Verified | genomic | 402 | | aaccctctaaagatattttNaaaggacttctaaaggaa |
| 100 | IGR1022a_2 | g/c | | Verified | genomic | 522 | | gtgcaaggccttaacgttttaNttgctctggtatcgca |
| 101 | IGR1022a_3 | t/c | | Verified | genomic | 608 | | tctagctctggctgNtgagtgtgtctgccag |
| 102 | IGR1023a_1 | a/c | | Verified | genomic | 477 | | tttggtaaataggaaatNgctccaactacttgtc |
| 103 | IGR1025a_1 | other/w+ | ca repeat | Verified | genomic | 557 | | ggagattttataNacacaca |
| 104 | IGR1026a_2 | other/w+ | Poly a | Verified | genomic | 429 | | ccctatctcaNaaaaa |
| 105 | IGR1026a_3 | ins/del | | Verified | genomic | 520 | | atgaaatgagatagtccagctaaaNgcccgaagag |
| 106 | IGR1027a_1 | a/g | | Verified | genomic | 480 | | agagcaagctNaggagctc |
| 107 | IGR1027a_2 | g/c | g on ref. sequence | Verified | genomic | 497 | | gctctggacggcNagccccggaacc |
| 108 | IGR1029a_1 | a/g | | Verified | genomic | 497 | | acaatgtgagNcaattagttt |
| 109 | IGR1030a_1 | a/g | | Verified | genomic | 554 | | agcactggggNacaatgtt |
| 110 | IGR1031a_1 | other/w+ | Poly t | Verified | genomic | 200 | | tcaggaatgacNttttttt |
| 111 | IGR1031a_3 | a/c | | Not yet verified | genomic | 565 | | aagagctacNgtcttaccaa |
| 112 | IGR1032a_1 | t/c | | Verified | genomic | 175 | | cctcacccNagcagtgaa |
| 113 | IGR1032a_2 | other/w+ | Poly t | Verified | genomic | 352 | | tatgaatttcNtttttt |
| 114 | IGR1034a_1 | a/g | | Verified | genomic | 293 | | tgcaatggcNcagtctcagct |
| 115 | IGR1039a_1 | t/g | | Verified | genomic | 462 | | ccttgggcacNctactcagcct |
| 116 | IGR1040a_1 | t/c | | Verified | genomic | 188 | | ctggccagaNgggccctcccc |
| 117 | IGR1040a_2 | t/g | | Verified | genomic | 356 | | aggatttcaNgcaggaaagt |
| 118 | IGR1040a_3 | a/c | | Verified | genomic | 633 | | agcttgtcagNcttcatctaatt |
| 119 | IGR1043a_1 | a/g | g in ref. sequence | Verified | genomic | 170 | | ggatctcgcacNggaaggaatt |
| 120 | IGR1043a_2 | a/g | | Verified | genomic | 377 | | gtactttgttNatttaaataat |
| 121 | IGR1045a_2 | t/c | | Verified | genomic | 200 | | ttgacaaaaNtggccatga |
| 122 | IGR1045a_3 | a/t | | Verified | genomic | 291 | | tagaagatttNaaaattgtaa |
| 123 | IGR1045a_4 | t/c | | Verified | genomic | 99 | | cacacgctcaNatccaagccaccccaa |
| 124 | IGR1046a_1 | t/g | | Verified | genomic | 301 | | gtgcatggNtgtccctcccc |
| 125 | IGR1046a_2 | t/c | | Verified | genomic | 337 | | tctctgttcNcatctttatc |
| 126 | IGR1046a_3 | t/c | | Verified | genomic | 572 | | tccatactNgttgaatg |
| 127 | IGR1047a_1 | ins/del | | Verified | genomic | 253 | | agagcacaNacacatgga |
| 128 | IGR1050a_1 | a/g | | Verified | genomic | 235 | | ctagatgaagggcataNgcagaagacattt |
| 129 | IGR1050a_2 | a/t | | Verified | genomic | 558 | | gggctgggttcccgNggtgccaagggg |
| 130 | IGR1052a_1 | t/c | | Verified | genomic | 319 | | cctccgtaaatatccttNcagccttaaaccct |
| 131 | IGR1055a_1 | a/g | | Verified | genomic | 566 | | atttaaatacNaggaaaaacaat |
| 132 | IGR1056a_2 | t/g | | Verified | genomic | 235 | | tattaccagggactcctggNgtccactgctttag |
| 133 | IGR1056a_3 | t/c | this base is missing on ref. seq. | Verified | genomic | 285 | | aaccccttggctccaagtgcNagcagccacagtcttc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 134 | IGR1057a__1 | t/c | this base is missing on ref. seq. | Verified | genomic | 271 | | ttcgaagtttcagttgaacNgtccctcgcgaaa |
| 135 | IGR1057a__2 | a/g | | Verified | genomic | 390 | | gacaaagaggtcagcacNgagtagaacgc |
| 136 | IGR1060a__1 | g/c | | Verified | genomic | 279 | | aaggagcggactctactaaNgaatcctcctgtaag g |
| 137 | IGR1060a__2 | t/g | | Verified | genomic | 306 | | tgtaagggcgggcctatNatggtgctggggagaat |
| 138 | IGR1063a__2 | a/g | | Verified | genomic | 425 | | tcctgctcttccctcNttttcctagaagtcctcc |
| 139 | IGR1064a__1 | t/g | | Verified | genomic | 335 | | tggccgtgtgaccccNctacgggcctgtttccta |
| 140 | IGR1066b__1 | a/g | | Verified | genomic | 90 | | taccaaagggccgctccNggcacttggcgcatgt g |
| 141 | IGR1068a__1 | other/ w+ | poly T | Verified | genomic | 141 | | ttcttaggtgttgNtttttttttttt |
| 142 | IGR1070a__2 | t/c | | Verified | genomic | 614 | | ttccattgttttcaNttggaatttatattttaatgt |
| 143 | IGR1070a__2 | t/c | | Verified | genomic | 614 | | ttccattgttttcaNttggaatttatattttaatgt |
| 144 | IGR1070a__3 | t/g | | Verified | genomic | 308 | | tctaactgtNtcttaaactg |
| 145 | IGR1071b__1 | t/c | | Not yet verified | genomic | 115 | | ttattccattgtttcaNttggaatttatatttta |
| 146 | IGR1072a__1 | t/c | | Verified | genomic | 337 | | ctgacatatttatttaNttattagtatttttttga |
| 147 | IGR1092a__1 | a/c | | Verified | genomic | 241 | | aagcagagccaNacatacatctcac |
| 148 | IGR1095a__1 | a/g | | Verified | genomic | 148 | | agaaagggactNtctggagccagg |
| 149 | IGR1095a__2 | g/c | | Verified | genomic | 213 | | tttttctctgccaNcatagtccttatgca |
| 150 | IGR1098a__1 | a/c | | Verified | genomic | 237 | | gcaagccagaNgacagggccacag |
| 151 | IGR1098a__2 | g/c | | Verified | genomic | 294 | | cctgtctttgaatNcaaactgctgtc |
| 152 | IGR1099a__1 | other/ w+ | Poly t | Verified | genomic | 216 | | atgcatggcatgttcNttt |
| 153 | IRG1099b__2 | a/g | | Not yet verified | genomic | 406 | | tagagacNgagtttcacc |
| 154 | IGR1099b__3 | a/g | | Not yet verified | genomic | 270 | | ctggagtNcaatggcacg |
| 155 | IGR1100a__1 | ins/ del | deletion of 1 g | Verified | genomic | 602 | | atgaaaactctaacggNtcttcagcttcttgttcta |
| 156 | IGR1100a__2 | a/t | t on ref. sequence | Verified | genomic | 103 | | tgattttagaatttattNaaaaaaagtcaa |
| 157 | IGR1102a__1 | t/c | | Verified | genomic | 605 | | tttttctttatNgcattttggct |
| 158 | IGR1102a__2 | t/c | | Verified | genomic | 400 | | aattagccaggNgtgggagcgcgca |
| 159 | IGR1102a__4 | a/g | | Not yet verified | genomic | 119 | | ctgacattaccagNggaaaacaatggctg |
| 160 | IGR1102a__6 | other/ w+ | Poly a | Verified | genomic | 549 | | cgagactccatctggNaaa |
| 161 | IGR1103a__1 | other/ w+ | Poly a | Verified | genomic | 78 | | aaaNgagtttcctctgg |
| 162 | IGR1104a__1 | g/c | g on ref. sequence | Verified | genomic | 526 | | cagcttcttatgttgNttttattcctcag |
| 163 | IGR1105a__1 | a/g | g in ref. sequence | Verified | genomic | 383 | | ttaggttcttggaagcNggtttatgaactaat |
| 164 | IGR1107a__1 | a/c | a in ref. sequence | Verified | genomic | 402 | | aagattcaatgNaatcagtgacttgt |
| 165 | IGR1109a__1 | a/g | a in ref. sequence | Verified | genomic | 415 | | ggtagatgtgNtattacaaagatg |
| 166 | IGR1110a__2 | ins/ del | | Verified | genomic | 195 | | aaaaaaNttattacccg |
| 167 | IGR1111a__1 | other/ w+ | Poly a | Verified | genomic | 481 | | gagctagactctgtctcNaaa |
| 168 | IGR1111a__2 | a/g | g in ref. sequence | Verified | genomic | 318 | | tctactaaaNatacaaaaa |
| 169 | IGR1111a__3 | a/g | g in ref. sequence | Verified | genomic | 325 | | atacaaNaattagcc |
| 170 | IGR1112a__1 | t/c | c on ref. sequence | Verified | genomic | 183 | | aaatacaaatagaNacatacaaaa |
| 171 | IGR1113b__2 | a/c | | Not yet verified | genomic | 293 | | taccttgaNgtgtgttctg |
| 172 | IGR1114a__1 | t/c | c on ref. sequence | Verified | genomic | 254 | | gtggctcacacNgcaatcccagcac |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 173 | IGR1114a_2 | a/g | a in ref. sequence | Verified | genomic | 312 | | cccaggaagtcNaggctgcagtg |
| 174 | IGR1115a_1 | other/ w+ | Poly a | Verified | genomic | 465 | | gagccagactctgtcttNaaaaa |
| 175 | IGR1115a_2 | a/c | | Verified | genomic | 307 | | ctctatctctactaaaNatacaaaaattag |
| 176 | IGR1115a_3 | t/c | | Verified | genomic | 322 | | atacaaaaattagcNggtgtggtggtggg |
| 177 | IGR1115a_4 | g/c | | Not yet verified | genomic | 438 | | gaatgaactccagcNtgggtgacagagcc |
| 178 | IGR1116a_1 | t/c | | Verified | genomic | 625 | | gactctaaggtgagcNctgaataaagccct |
| 179 | IGR1118a_1 | a/g | | Verified | genomic | 192 | | gtatattgtattagtatNgggtaatacattccaaatg |
| 180 | IGR1118a_2 | other/ w+ | Poly a | Verified | genomic | 47 | | ggcaaaaagagcgaaactctgtctcaaaaaaN |
| 181 | IGR1118a_3 | t/c | | Verified | genomic | 619 | | agcctggctttgttccttaaNaagcctaaattgctag aa |
| 182 | IGR1119a_1 | a/g | | Verified | genomic | 190 | | ccaagctccctcatagNtcctcattctgctcag |
| 183 | IGR1120a_1 | ins/ del | | Verified | genomic | 258 | | ttttctttttttttNctgagacagtttttc |
| 184 | IGR1126a_1 | other/ w+ | Poly a | Verified | genomic | 196 | | agagactccgtctcNaaaaa |
| 185 | IGR1142a_1 | ins/ del | deletion of 2 bp | Verified | genomic | 526 | | ttttctgcagtaatacNtattaaaaatttagattc |
| 186 | IGR1142a_2 | t/c | | Verified | genomic | 321 | | cagaaccctcatagcatgNgatcactgataaag |
| 187 | IGR1144a_1 | t/c | | Verified | genomic | 435 | | catcaacaaggttcttaNagaattcctaagg |
| 188 | IGR1144a_2 | a/g | | Verified | genomic | 611 | | aaatgagaaaatctaNaatgaatctctgt |
| 189 | IGR1145a_1 | a/g | | Verified | genomic | 338 | | tatcacttcttcagtNataaagttcttaa |
| 190 | IGR1145a_2 | g/c | | Verified | genomic | 463 | | aacaggtatttaatattcttcacattNcagtaataaa gac |
| 191 | IGR1148a_1 | other/ w+ | poly T | Verified | genomic | 304 | | ttttagagNtttttt |
| 192 | IGR1157b_1 | t/c | | Not yet verified | genomic | 301 | | aagtgctggNatatacac |
| 193 | IGR1161a_1 | t/c | | Verified | genomic | 221 | | cagtcctatatttcaaaNgagcaaacagaca |
| 194 | IGR1161a_2 | t/c | | Verified | genomic | 662 | | aaactattttactaaaNagaagtcccatta |
| 195 | IGR1169a_1 | other/ w+ | Poly a | Verified | genomic | 384 | | aaactctatcttNaaaaaaaaaaa |
| 196 | IGR1169a_2 | a/c | | Verified | genomic | 454 | | tgttgtgcaNagtaagagaa |
| 197 | IGR1172a_1 | t/c | | Not yet verified | genomic | 587 | | cctaacattaNttcaaaataa |
| 198 | IGR1173a_1 | a/t | | Not yet verified | genomic | 517 | | agtttttttNaaattttt |
| 199 | IGR1185a_1 | t/c | | Verified | genomic | 516 | | aaaaattaNaaaaattagc |
| 200 | IGR1185a_2 | t/c | | Verified | genomic | 576 | | aggctgaggNatgggaatc |
| 201 | IGR1186a_1 | a/t | | Verified | genomic | 210 | | aacaagcttNtctttaaac |
| 202 | IGR1186a_2 | ins/ del | | Verified | genomic | 423 | | ttttttttNagctctgattc |
| 203 | IGR1193a_1 | a/g | | Verified | genomic | 343 | | atgctagcNatgtaaaaaa |
| 204 | IGR1196a_1 | t/c | | Not yet verified | genomic | 109 | | aaaaaaacaNaaggcact |
| 205 | IGR1196a_2 | a/g | | Not yet verified | genomic | 202 | | gaagggtcaNacaggaaag |
| 206 | IGR1196a_4 | t/c | | Verified | genomic | 457 | | ggagcaaaaNaaatgttta |
| 207 | IGR1199a_1 | a/g | | Verified | genomic | 201 | | atatattccNagaaatgcat |
| 208 | IGR1199a_2 | t/g | | Verified | genomic | 214 | | aaatgcatcaNtaggcaattt |
| 209 | IGR1200a_1 | other/ w+ | Poly a | Verified | genomic | 516 | | gacgaccttttNaaaaaaaaa |
| 210 | IGR1218a_1 | t/c | | Verified | genomic | 469 | | ttttaataacNtgtaaaatgcc |
| 211 | IGR1218a_2 | a/g | | Verified | genomic | 590 | | gctgctggNtgagaggt |
| 212 | IGR1219a_1 | t/c | | Verified | genomic | 129 | | gcttttaaaNttttct |
| 213 | IGR1219a_2 | t/c | | Verified | genomic | 195 | | ctacaaagtNtatttaaggg |
| 214 | IGR1219a_3 | a/t | | Not yet verified | genomic | 251 | | ttttgcttcaNagcctttcctt |
| 215 | IGR1258a_1 | other/ w+ | gt repeat | Verified | genomic | 177 | | taaactatatataNgtgtgtgt |
| 216 | IGR1258a_2 | t/c | | Verified | genomic | 436 | | tctgggagtaNtggcacaca |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 217 | IGR1279a_1 | g/c | | Verified | genomic | 223 | | accagtaattatttaaaaatNaaagtactaattgttt |
| 218 | IGR1279a_2 | t/g | | Verified | genomic | 569 | | agccgggcgtggtggcagNtgcctgtaatccagct |
| 219 | IGR1286a_1 | g/c | | Verified | genomic | 365 | | gttttgagaNagtctcactct |
| 220 | IGR1319a_1 | a/c | | Not yet verified | genomic | 200 | | taattttaaaggctctgNtccctgctcttttc |
| 221 | IGR1350a_1 | t/c | | Verified | genomic | 125 | | acttccttcNctccccaggg |
| 222 | IGR1353a_1 | g/c | | Verified | genomic | 643 | | ctccaagggaNctctgctcc |
| 223 | IGR1353a_2 | t/c | | Verified | genomic | 438 | | tggatggaNggacgaac |
| 224 | IGR1356a_1 | ins/w+ | | Verified | genomic | 172 | | taggggaggNcattccag |
| 225 | IGR1362a_1 | t/c | | Verified | genomic | 434 | | caaggggaagNgcattccag |
| 226 | IGR1363a_1 | a/g | G in ref sequence | Verified | genomic | 382 | | gcagtgggNcaagtgtgg |
| 227 | IGR1364a_1 | del/w+ | | Verified | genomic | 147 | | gtttgttNgttttttgag |
| 228 | IGR1365a_1 | t/c | | Verified | genomic | 160 | | actgggatgNtcctaaactg |
| 229 | IGR1365a_2 | ins/w+ | | Verified | genomic | 211 | | gactttttNaatagagat |
| 230 | IGR1366a_1 | a/g | | Verified | genomic | 371 | | caagacagtgNataaatagc |
| 231 | IGR1367a_1 | a/g | | Verified | genomic | 73 | | aaagaaaaNtcagaattt |
| 232 | IGR1367a_2 | del/w+ | | Not yet verified | genomic | 425 | | cctccttccccNcttctctc |
| 233 | IGR1369a_1 | a/c | | Verified | genomic | 44 | | tcaaaagagaNcaatgatga |
| 234 | IGR1369a_2 | a/c | | Verified | genomic | 91 | | aaagtactaNtatgaaaat |
| 235 | IGR1370a_2 | del/w+ | | Not yet verified | genomic | 350 | | tatatataNacacacatac |
| 236 | IGR1370a_3 | t/g | | Verified | genomic | 241 | | gaagaaaNagtgcagtg |
| 237 | IGR1371a_1 | t/c | | Verified | genomic | 72 | | aaaatatgcNtcaggagtga |
| 238 | IGR1371a_2 | a/g | | Verified | genomic | 231 | | aaaaaaagNccaacagaaa |
| 239 | IGR1372a_1 | other/w+ | poly t | Verified | genomic | 298 | | ttttttttNagggagagt |
| 240 | IGR1372a_2 | t/c | | Verified | genomic | 323 | | ttctgttgctcNggctggagt |
| 241 | IGR1373a_1 | t/c | | Verified | genomic | 338 | | aacttagaaNtctcccagg |
| 242 | IGR1375a_1 | t/c | | Verified | genomic | 96 | | aggaattgaaNttaataga |
| 243 | IGR1376a_1 | a/t | A in ref sequence | Verified | genomic | 462 | | cacttgtgNtgattaat |
| 244 | IGR1376a_2 | del/w+ | | Verified | genomic | 79 | | gcaagaagcNcaacaaacc |
| 245 | IGR1380a_1 | other/w+ | poly t | Verified | genomic | 573 | | agtctccaacNtttttt |
| 246 | IGR1380a_2 | a/g | | Verified | genomic | 155 | | ttaatatgatNaaatgctcaa |
| 247 | IGR2001b_1 | a/c | | Verified | genomic | 148 | | cccccacaaagNccgagaagcct |
| 248 | IGR2002a_1 | a/c | | Verified | genomic | 357 | | aaaatcgagatgaaggNtttgagcatttcagaga |
| 249 | IGR2003a_1 | a/g | | Verified | genomic | 234 | | ttgcagtgagccNagatcacgtcact |
| 250 | IGR2004a_1 | ins/del | deletion of 14 bp | Verified | genomic | 576 | | tagagtttgttcccNagagtttgttccca |
| 251 | IGR2006a_1 | t/c | | Verified | genomic | 122 | | ctttagtttcatcttNcctactgcca |
| 252 | IGR2006a_2 | a/g | | Verified | genomic | 380 | | ctggctccNaattaataag |
| 253 | IGR2007a_1 | other/w+ | Poly a | Verified | genomic | 459 | | taaagtaagaatccctaaggttNaaaaaaaaaaaag |
| 254 | IGR2008a_1 | t/c | | Verified | genomic | 646 | | ttacttctgcaggagctNtagggagatgaaggaagaagcc |
| 255 | IGR2008a_2 | g/c | | Verified | genomic | 596 | | ccctggagggagagctgNggtgaaggaaatgacac |
| 256 | IGR2009a_1 | ins/del | deletion of "c" | Verified | genomic | 270 | | agagttaagtaggggNccttaccaaggagcat |
| 257 | IGR2010a_2 | t/c | | Verified | genomic | 359 | | aggctttctgcctNcttcacttcccca |
| 258 | IGR2010a_3 | a/g | | Verified | genomic | 233 | | ggtagggctactNttatttatggtt |
| 259 | IGR2010a_4 | a/g | | Verified | genomic | 113 | | cctggtcactattaNacccctgcaacggcg |
| 260 | IGR2010a_6 | a/g | | Verified | genomic | 329 | | agcacacggggcaNggtaggcttctgcc |
| 261 | IGR2011a_2 | a/g | | Verified | genomic | 43 | | gggcgatcacctcNcctgcgttcggg |
| 262 | IGR2011a_3 | a/g | | Verified | genomic | 153 | | acaggctggggccNggggcgctgggc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 263 | IGR2011b_1 | g/c | | Verified | genomic | 396 | | agacgtgcgcccgagccccgccgaaNcgaggc cacccggagccgtgccc |
| 264 | IGR2011b_2 | t/c | | Not yet verified | genomic | 500 | | CCACTCGGAGTCGCGCTNCGCGC GCCCTCACTGCAGCCCC |
| 265 | IGR2013a_1 | g/c | | Verified | genomic | 431 | | aaaggatttgaattttgagNgaaaagtt |
| 266 | IGR2015a_1 | t/g | | Verified | genomic | 443 | | ctcgcagtagtcctgtgggNtagatcttactaatgtc |
| 267 | IGR2016a_1 | a/t | | Verified | genomic | 366 | | ggaagaagttcttacttccNtgtgggtgctta |
| 268 | IGR2016a_2 | a/g | | Verified | genomic | 120 | | acttcatatttNtcactgtgtccc |
| 269 | IGR2017a_1 | t/c | | Verified | genomic | 412 | | ggtccctgagctcccNgagacaacatgcagaatt actg |
| 270 | IGR2018a_1 | t/c | | Verified | genomic | 245 | | gtcagcccacccattNagtaactgttctctgctg |
| 271 | IGR2020a_1 | a/c | | Verified | genomic | 568 | | gagagagaaaagatgNtcagaactccacctggc ac |
| 272 | IGR2020a_15 | t/g | | Verified | genomic | 408 | | tctccccgactNgcacatcccagt |
| 273 | IGR2020a_2 | a/g | | Verified | genomic | 379 | | ccccagcactgtcgccNtgtgctgtcagcagcact ctccc |
| 274 | IGR2020a_3 | t/c | | Verified | genomic | 362 | | acctgtggcttctgctgtNccccagcactgtcgcc |
| 275 | IGR2020a_4 | a/g | | Verified | genomic | 301 | | gcaggggttggtcggNgggcgctcgatgtcttgcaa actaa |
| 276 | IGR2020a_5 | a/g | | Verified | genomic | 210 | | caggtctggcaggNgaccccacaggtcagtggg atgactc |
| 277 | IGR2020a_9 | a/g | | Verified | genomic | 194 | | actccaggtgagctgNtccaggtctggc |
| 278 | IGR2021a_1 | ins/del | | Not yet verified | genomic | 233 | | ggccaggggtgcattttgNggtgctggttctccttcct c |
| 279 | IGR2021a_2 | a/g | | Verified | genomic | 147 | | ccatagggggaggcaagcgacNgggacactag gaaggca |
| 280 | IGR2021a_3 | t/g | | Verified | genomic | 197 | | ctgcagtacagtgggggctNgagaggaggga aggg |
| 281 | IGR2021a_4 | other/ w+ | gt repeat | Verified | genomic | 394 | | gtgtgNcagagagacagagagacagagagaga g |
| 282 | IGR2021a_5 | ins/del | deletion of 16 bp | Verified | genomic | 277 | | gcccagcatctgagggNtaggggtgtaatacggc a |
| 283 | IGR2022a_1 | t/c | | Verified | genomic | 612 | | aggtcaggagttNgagaccagcctgactaacatg gtgaaa |
| 284 | IGR2022a_2 | t/c | | Verified | genomic | 439 | | aatcagcctttaggatcNgttaatatgatgatggcttt |
| 285 | IGR2022a_3 | t/c | | Verified | genomic | 190 | | ctgttgtcacctggctgNttgcattgtcccacaagtg c |
| 286 | IGR2022a_4 | a/g | | Verified | genomic | 248 | | ggaaagccaccatNggaagggaaggcagg |
| 287 | IGR2024a_1 | t/g | | Verified | genomic | 163 | | gccaagggtgtgatactggctNagaggagctggc tca |
| 288 | IGR2024a_2 | a/g | | Verified | genomic | 461 | | atggagaaagcttgggggcaggNccagggagc agg |
| 289 | IGR2024a_3 | t/g | | Verified | genomic | 517 | | cacattgtgaattagctacNgctgccatgccttaag g |
| 290 | IGR2024a_7 | a/g | | Verified | genomic | 468 | | gggcagggccagggNgcagggcggtaaa |
| 291 | IGR2025a_1 | t/c | | Verified | genomic | 139 | | cctgatgccaccgtcccNtaccctcatacaac |
| 292 | IGR2025a_2 | a/g | | Verified | genomic | 141 | | ctgatgccaccgtcccctNccctcatacaaccttctt |
| 293 | IGR2025a_5 | a/g | | Verified | genomic | 270 | | ttgccctccatccaNgccattccctgt |
| 294 | IGR2025a_6 | a/g | | Verified | genomic | 377 | | aagctggacttctgtNggcccctcaac |
| 295 | IGR2026a_1 | ins/del | deletion of "c" | Verified | genomic | 244 | | cacaaagaactaccccNttttcagctgagccc |
| 296 | IGR2026a_2 | a/g | | Verified | genomic | 314 | | gtggggtccttcggggcNatgctccctcagcctc |
| 297 | IGR2026a_3 | ins/del | ins/del "a" | Verified | genomic | 611 | | tcatgtgtgaacacataNgacgtgtgtaaatatgta |
| 298 | IGR2027a_1 | ins/del | ins/del "g" | Verified | genomic | 166 | | aaagtaaattgtttataaNgggtgtggccttttttagag a |
| 299 | IGR2027a_2 | a/g | | Verified | genomic | 291 | | gaacagggacatgcatctNttataaaatcctttcg |
| 300 | IGR2027a_3 | a/c | | Verified | genomic | 309 | | ttataaaatcctttcggNcaggcgcggtggctcaca cctg |
| 301 | IGR2027a_4 | t/c | | Verified | genomic | 386 | | tcacctgaggtcaggagttNgagaccagcctggtg aaa |
| 302 | IGR2027a_5 | other/ w+ | Poly a | Verified | genomic | 562 | | actccagcccgggcaccNaaaaaa |

TABLE 3-continued

Legend:
EST: expressed sequence tag
gene: known gene
Predicted gene: gene predicted from genomic sequence using the GENSCAN package
ins/del: insertion/deletion
genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 303 | IGR2029a__1 | a/g | | Verified | genomic | 112 | | tgaacccgggagatgNaggttgcagtgagct |
| 304 | IGR2029a__2 | t/c | | Verified | genomic | 166 | | tccagcctgggtgacaagagNgagactttgtctcaaa |
| 305 | IGR2029a__3 | other/ w+ | Poly a | Verified | genomic | 180 | | ttgtctcaaaaaaaaaaaaatcctttg |
| 306 | IGR2030a__1 | t/g | | Verified | genomic | 539 | | gaaggtgtggatatgtgcNtttcctgtctccct |
| 307 | IGR2031a__1 | t/g | | Verified | genomic | 415 | | gatgctgtgtgagtggcaggNggactcctgctgggta |
| 308 | IGR2031a__3 | t/g | | Verified | genomic | 40 | | tgtggatatgtgcNtttcctgtctccct |
| 309 | IGR2031a__4 | a/g | | Verified | genomic | 227 | | ctcagtcccagaaaccNtatgtactgtgac |
| 310 | IGR2031a__5 | t/g | | Verified | genomic | 232 | | ctcagtcccagaaaccatatgNactgtgaccccgctcact |
| 311 | IGR2032a__1 | ins/del | | Verified | genomic | 126 | | tctctactaaaaaNaactaaccaggcgtggtgg |
| 312 | IGR2032a__2 | a/g | | Verified | genomic | 356 | | ggaacagaggNatagacagga |
| 313 | IGR2032a__3 | other/ w+ | Poly a | Verified | genomic | 278 | | agactctgtctcNaaaaa |
| 314 | IGR2033a__1 | t/c | | Verified | genomic | 587 | | atcattctaaggaNctgacagtgcttctg |
| 315 | IGR2034a__1 | t/g | | Verified | genomic | 441 | | gaagctaataNgcaaaccatc |
| 316 | IGR2036a__1 | g/c | | Verified | genomic | 356 | | acctcaaagtNtggctggata |
| 317 | IGR2036a__2 | a/g | | Verified | genomic | 183 | | gtaagacacaNgcctgcagag |
| 318 | IGR2037a__1 | ins/del | ct repeat | Verified | genomic | 534 | | aagacaacctagtctNctgttctgctttaaa |
| 319 | IGR2038a__1 | ins/del | aaac repeat | Verified | genomic | 532 | | tgagttcttacacagtggtNaaacaaaca |
| 320 | IGR2039a__1 | ins/del | | Verified | genomic | 394 | | tgcttggctNgttgggat |
| 321 | IGR2041a__1 | a/g | | Verified | genomic | 331 | | cacgtattaaagccacctacNatataccaccc |
| 322 | IGR2042a__2 | t/c | | Verified | genomic | 270 | | gagggccaaaggctttgtcctgccNctcctgccct |
| 323 | IGR2043a__1 | a/g | | Not yet verified | genomic | 334 | | tctgatagtggcNggaacatcctgact |
| 324 | IGR2047a__1 | other/ w+ | Poly t | Verified | genomic | 225 | | tgtggggctttgcNttttt |
| 325 | IGR2049a__2 | t/c | t on ref. sequence | Verified | genomic | 332 | | gaccccctgcttacatNgtacataacaatagctata |
| 326 | IGR2051a__1 | t/c | t on ref. sequence | Verified | genomic | 470 | | ggcagggNtgtctggcaagggaccagtcc |
| 327 | IGR2051a__2 | a/g | | Verified | genomic | 605 | | acacttattNtaactgtcaccctgggcccat |
| 328 | IGR2052a__1 | t/c | | Verified | genomic | 290 | | gctattttcttcNttgtattctgcagtgaccagg |
| 329 | IGR2052a__2 | a/g | | Verified | genomic | 106 | | ttgacaaacacttattNtaactgtcacc |
| 330 | IGR2053a__1 | a/g | | Verified | genomic | 225 | | cattcactgtgctgttcNgggctagagaaga |
| 331 | IGR2053a__2 | a/c | | Verified | genomic | 369 | | cactgctgctctgcagtgacNcctgcttcccccctaagt |
| 332 | IGR2053a__3 | t/c | | Verified | genomic | 544 | | gtgaccctattggatcttctcaNgccactgagggatat |
| 333 | IGR2054a__1 | t/c | | Verified | genomic | 196 | | caagagggaatggagtctttNgcagaggggctg |
| 334 | IGR2054a__2 | ins/del | ins/del 6 bp | Verified | genomic | 591 | | cttctgcttctgcttctgNccccttctgcctc |
| 335 | IGR2055a__1 | t/g | | Verified | genomic | 609 | | gagtgtggtttgagaagaNtctgaggagtgggac |
| 336 | IGR2056a__1 | a/g | | Verified | genomic | 153 | | tttttaaagactagtcNctgggcgcggt |
| 337 | IGR1056a__2 | a/c | | Verified | genomic | 364 | | gagaatggcgtgaacccgggaggNagagcttgcagt |
| 338 | IGR2056a__3 | other/ w+ | Poly a | Verified | genomic | 481 | | aagcgagactccatctcNaaaaaaaaacaaaaaacaa |
| 339 | IGR2056a__4 | g/c | | Verified | genomic | 432 | | gagcttgcagtgagctgaNatcgcgccactgcact |
| 340 | IGR2057a__1 | a/g | | Verified | genomic | 421 | | gaagtgaaaaccaaatNcaagggctacaga |
| 341 | IGR2060a__1 | g/c | | Verified | genomic | 514 | | ttgcaaccctNgcaaaggtaa |
| 342 | IGR2061a__3 | t/c | | Verified | genomic | 236 | | catacacaagaaNggttcatttactg |
| 343 | IGR2062a__1 | ins/del | caaa repeat | Verified | genomic | 195 | | aaaacaaacaaacaaacaaacaaaNacactgtcatgcc |
| 344 | IGR2063b__1 | g/c | c on ref. sequence | Verified | genomic | 218 | | ggcaaataatNacatggatctc |
| 345 | IGR2063b__2 | t/g | t on ref. sequence | Verified | genomic | 369 | | agttggcagNggggctggttc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 346 | IGR2064a__1 | a/c | | Verified | genomic | 364 | | aaactgtgatttNcagtttcattt |
| 347 | IGR2064a__2 | a/g | | Verified | genomic | 508 | | ccctcagagggcNggtactggact |
| 348 | IGR2066a__2 | t/c | | Verified | genomic | 459 | | cttcatctctccctgccaaNgaagctggtggtgccc |
| 349 | IGR2067a__1 | a/g | | Verified | genomic | 163 | | agccactacttgggcNgctcagctc |
| 350 | IGR2067a__2 | a/g | | Verified | genomic | 243 | | cacacttctcccacNagaaataaagcaagca |
| 351 | IGR2067a__3 | t/c | | Verified | genomic | 266 | | agcaagcagctgttNctctcttgggccc |
| 352 | IGR2067a__4 | a/g | | Verified | genomic | 485 | | agcctgagcctNgcgcagcccagac |
| 353 | IGR2068a__1 | other/w+ | ca repeat | Verified | genomic | 354 | | acacacacacacaNtttttgagagagag |
| 354 | IGR2068a__2 | g/c | | Verified | genomic | 70 | | atgtgtagtgtgtgagaaNgtgtgagaggtactcg |
| 355 | IGR2069a__1 | a/g | g in ref. sequence | Verified | genomic | 394 | | ttatgttccattgtacNtattcaccatatttt |
| 356 | IGR2069a__2 | t/c | | Verified | genomic | 425 | | atccactcctcNtgtcatggacatctg |
| 357 | IGR2070a__1 | t/c | | Verified | genomic | 551 | | tctaaagaaaaagaaagcNgtgaattcttggac |
| 358 | IGR2071a__1 | t/g | g on ref. sequence | Verified | genomic | 165 | | gctctgtgccaggcaggggNctccgaggtgagtgt |
| 359 | IGR2071a__2 | a/t | a on ref. sequence | Verified | genomic | 171 | | ccaggcaggggctccgNggtgagtgtggcct |
| 360 | IGR2071a__3 | a/g | a in ref. sequence | Verified | genomic | 365 | | agagaagggaactggcNtgtgtggctgggctgtg |
| 361 | IGR2072a__1 | a/g | a in ref. sequence | Verified | genomic | 312 | | gcaggctcagtggaaggagaggNgtctccttatg |
| 362 | IGR2072a__2 | t/c | t on ref. sequence | Verified | genomic | 408 | | atggggaactctcctaNactgctggaggcgtg |
| 363 | IGR2073a__1 | a/c | a in ref. sequence | Verified | genomic | 94 | | agtcatggcactaNatggagcccaggg |
| 364 | IGR2073a__2 | a/g | a in ref. sequence | Verified | genomic | 313 | | caccaggaggttcagcNcccactgtgg |
| 365 | IGR2073a__3 | t/c | c in ref. sequence | Verified | genomic | 379 | | gcatcccagcgccNggccagtggtcc |
| 366 | IGR2074a__1 | ins/del | | Verified | genomic | 239 | | gagtaaggggtcNaggaggggggggtggc |
| 367 | IGR2076a__1 | t/c | t on ref. sequence | Verified | genomic | 184 | | gaacatactcataNccatgcttcccc |
| 368 | IGR2076a__2 | other/w+ | Poly t | Verified | genomic | 647 | | tacacttatggtttgtgcNtttttttt |
| 369 | IGR2077a__1 | other/w+ | Poly t | Verified | genomic | 148 | | tatggtttgtgcNtttttttttt |
| 370 | IGR2078a__1 | a/g | g in ref. sequence | Verified | genomic | 197 | | gcagggtggggagaaNgccagactcagggtg |
| 371 | IGR2078a__2 | ins/del | ins/del "c" | Verified | genomic | 67 | | ggccccagccccccccNggaagtggat |
| 372 | IGR2079a__1 | ins/del | Poly a | Verified | genomic | 345 | | gtaaaaaaaaaNccctacaggtaaaag |
| 373 | IGR2079a__2 | t/c | t on ref. sequence | Verified | genomic | 582 | | ccccccatgtgccaNgtcacctcccttgtc |
| 374 | IGR2081a__1 | a/g | a in ref. sequence | Verified | genomic | 140 | | cccagcaggaaacaNatgcaca |
| 375 | IGR2081a__2 | a/t | t in ref. sequence | Verified | genomic | 315 | | gaacccagagagaccNgtaggaggg |
| 376 | IGR2081a__3 | a/g | a in ref. sequence | Verified | genomic | 622 | | gcccggcagagtcaccNgggctggcc |
| 377 | IGR2083a__1 | t/c | | Verified | genomic | 372 | | aaatggggccaggNgcggtggctca |
| 378 | IGR2083a__2 | ins/del | | Not yet verified | genomic | 199 | | cctgtcttaaaaaaaaaaNNNgctgggtgtggtg |
| 379 | IGR2083a__3 | a/g | g in ref. sequence | Verified | genomic | 572 | | aattgcttgaacccNggaggcagaggtt |
| 380 | IGR2084a__2 | ins/del | ccaa repeat | Verified | genomic | 166 | | ccaaccaaccaNccaaatggtattaactctc |
| 381 | IGR2085a__1 | t/c | c on ref. sequence | Verified | genomic | 131 | | cacttaccttgcccNgccccaccc |
| 382 | IGR2085a__2 | a/g | a on ref. sequence | Verified | genomic | 249 | | tccttccttgaacctNtgtggatttct |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 383 | IGR2085a_3 | a/g | a on ref. sequence | Verified | genomic | 437 | | tggtcaacagtcccaNctgagcccagcc |
| 384 | IGR2085a_4 | a/g | | Verified | genomic | 368 | | cttgaggtgcctcNtaagaggtccaatga |
| 385 | IGR2085a_5 | t/c | | Verified | genomic | 538 | | ttattccagtcacctNgagtcattccagtc |
| 386 | IGR2087a_3 | other | gaa repeat | Not yet verified | genomic | 193 | | agggaagaagaagaaNcaagaggaagagga |
| 387 | IGR2087a_4 | other/ w+ | Poly a | Verified | genomic | 504 | | gaaagccaaaattaaaaaaaaaNtcaacagaa |
| 388 | IGR2090a_1 | a/c | a in ref. sequence | Verified | genomic | 219 | | agtcaggctgtctcggcNgctaaaagaggc |
| 389 | IGR2090a_2 | t/c | | Verified | genomic | 360 | | tgcttggtggggctcNagcgttaccgccg |
| 390 | IGR2090a_3 | t/c | c on ref. sequence | Verified | genomic | 444 | | ttcacccattgttctcNctattcccttt |
| 391 | IGR2090a_4 | other/ w+ | Poly t | Verified | genomic | 532 | | acttacctgctgaaatgcactgNttttttttt |
| 392 | IGR2091a_1 | t/g | | Verified | genomic | 581 | | taatgacattcccttgtaNgaatgtgccaatgtgga |
| 393 | IGR2091a_3 | a/c | a in ref. sequence | Not yet verified | genomic | 391 | | gatcacattaNttgcctgagtt |
| 394 | IGR2091a_4 | t/c | | Not yet verified | genomic | 404 | | ttgcctgagttcNcaagttggttaagaga |
| 395 | IGR2091a_5 | ins/del | | Not yet verified | genomic | 547 | | tctcatcaataaatatttatNNNcttcatcatt |
| 396 | IGR2092a_2 | ins/del | Poly a | Verified | genomic | 435 | | aaaaaaaaaaaaaNggccaggcgcg |
| 397 | IGR2093a_1 | ins/del | Poly a | Verified | genomic | 229 | | aaaaaaaaaNgcccctagaccctctg |
| 398 | IGR2093a_2 | a/g | g in ref. sequence | Not yet verified | genomic | 123 | | ttgggaggctgaggcNgaagaatcgct |
| 399 | IGR2093a_3 | t/c | | Verified | genomic | 181 | | agattgtgccactgNgcttcagtct |
| 400 | IGR2093a_4 | a/g | g in ref. sequence | Verified | genomic | 318 | | gggagacccggagggagNtagggaagtg |
| 401 | IGR2095a_1 | t/c | c on ref. sequence | Verified | genomic | 421 | | caacagcctggcagNgagggcctgtct |
| 402 | IGR2096a_1 | a/c | c in ref. sequence | Verified | genomic | 112 | | actagagggttttttaNagagaagtgacatgat |
| 403 | IGR2096a_2 | a/g | | Verified | genomic | 498 | | taaggaatacggttttgNacgtaagtgtgagatgcct |
| 404 | IGR2097a_1 | a/c | | Not yet verified | genomic | 58 | | caggtggaaNtgtgaatctggggagag |
| 405 | IGR2097a_2 | ins/del | Poly a | Verified | genomic | 463 | | aagactctgtctcNaaaaa |
| 406 | IGR2101a_1 | t/c | | Not yet verified | genomic | 283 | | cccagaatagagaccacNtccatcctcccctt |
| 407 | IGR2102a_1 | g/c | g on ref. sequence | Verified | genomic | 166 | | gaacttagatttgcgNcccttagcattcaac |
| 408 | IGR2102a_2 | t/g | g on ref. sequence | Verified | genomic | 223 | | caatgcatgatcctNtctgagcctcagc |
| 409 | IGR2105a_1 | a/t | | Not yet verified | genomic | 493 | | ttgatactcagtaNgtacagcttatt |
| 410 | IGR2106a_1 | other/ w+ | ct repeat | Verified | genomic | 137 | | caggcaacaaaNtctccctccct |
| 411 | IGR2107a_1 | t/c | c on ref. sequence | Verified | genomic | 300 | | ccttgcttcaaNtgcttcagtctatc |
| 412 | IGR2107a_2 | t/c | t on ref. sequence | Verified | genomic | 564 | | ccaaaggtcNcaggctctggc |
| 413 | IGR2108a_1 | ins/del | | Verified | genomic | 360 | | ccattccctgagcNcaggttgcctttct |
| 414 | IGR2109a_1 | a/g | | Verified | genomic | 400 | | ggccaggctggtctcNgtctagactcaagtg |
| 415 | IGR2110a_1 | t/c | | Not yet verified | genomic | 286 | | tgtttgagacagggtcttgNtctgtcgtccaggatgg |
| 416 | IGR2110a_2 | other/ w+ | Poly t | Verified | genomic | 420 | | atgcccagctaNtttttt |
| 417 | IGR2111a_1 | a/g | | Verified | genomic | 55 | | ccaccgcacccggccaNttttatttgttttaaa |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 418 | IGR2111a_3 | t/c | c on ref. sequence | Verified | genomic | 516 | | ttgccaacatttggtatNatcagtcttcaatttt |
| 419 | IGR2112a_1 | other/ w+ | Poly t | Verified | genomic | 285 | | ttttttttttNctgagacagagtctcgct |
| 420 | IGR2114a_1 | other/ w+ | Poly a | Verified | genomic | 3331 | | caattgacttccctNaaaaa |
| 421 | IGR2117a_1 | a/g | | Verified | genomic | 355 | | aagggtgtgcctagNgcacacactccctccc |
| 422 | IGR2121a_1 | other/ w+ | Poly a | Verified | genomic | 609 | | aataaagtgattacttNaaaaaaaaaaa |
| 423 | IGR2121a_2 | a/t | | Verified | genomic | 117 | | gagggcctgacagNttgaaggggttg |
| 424 | IGR2121a_3 | t/c | | Verified | genomic | 815 | | cctctggggtNtttccaaatca |
| 425 | IGR2123a_1 | a/g | g in ref. sequence | Verified | genomic | 230 | | ttgccagaacacNgggtcagagagcaagag |
| 426 | IGR2125a_1 | other/ w+ | Poly a | Verified | genomic | 546 | | agagtgagactctgtctcaaaaaaaaaaaaa |
| 427 | IGR2126a_1 | a/g | | Verified | genomic | 364 | | cttcatatctacttNgaaaaccatat |
| 428 | IGR2126a_2 | other/ w+ | Poly a | Verified | genomic | 47 | | gagactctgtctcNaaaaa |
| 429 | IGR2131a_1 | other/ w+ | Poly a | Verified | genomic | 249 | | aaaaaaaaaaaNgaacctctgtcgta |
| 430 | IGR2134a_1 | a/g | a on ref. sequence | Verified | genomic | 339 | | acttccagattaataNgtcttaacccat |
| 431 | IGR2136a_2 | t/c | | Verified | genomic | 444 | | tgctgtagctccatttgagNagggaccctt |
| 432 | IGR2138a_1 | a/g | | Verified | genomic | 375 | | atgatttgcNtcaaagcag |
| 433 | IGR2144a_1 | t/g | | Not yet verified | genomic | 384 | | tcagtaccacatctgtNtttccatgctctt |
| 434 | IGR2144a_2 | other/ w+ | Poly a | Verified | genomic | 463 | | acagaggtaaaagtgttttgaaagcNaaaaa |
| 435 | IGR2144a_3 | a/t | | Verified | genomic | 127 | | ctagcctaNggtctaggcc |
| 436 | IGR2144a_4 | t/c | | Verified | genomic | 137 | | ggtctaggcNctcctgcctg |
| 437 | IGR2144a_5 | a/g | | Verified | genomic | 166 | | ggaatcattacNatatcacaatca |
| 438 | IGR2147a_1 | a/g | | Not yet verified | genomic | 354 | | accatggatgcNtagctgagttcctg |
| 439 | IGR2148a_1 | t/c | | Verified | genomic | 253 | | acagttgtccctNagcatcttcgagga |
| 440 | IGR2148a_2 | other/ w+ | caaaaa repeat | Not yet verified | genomic | 619 | | gagacttcatctNaaaaacaaaaaacaaacaaa caaaaaa |
| 441 | IGR2150a_1 | g/c | | Verified | genomic | 90 | | aaactctcaccacNactgaaatctggtta |
| 442 | IGR2150a_2 | t/g | | Not yet verified | genomic | 336 | | ccctggggctctaNtatttggtgttac |
| 443 | IGR2150a_3 | t/g | | Verified | genomic | 558 | | gaaagatataNaaattaaattaaa |
| 444 | IGR2151a_1 | other/ w+ | Poly a | Verified | genomic | 202 | | aaaaaNtcataccaattagtctcacttaaa |
| 445 | IGR2151a_2 | a/g | | Verified | genomic | 566 | | catcctgcaNccccagcttc |
| 446 | IGR2153a_1 | a/g | a on ref. sequence | Verified | genomic | 423 | | cagaacaaattagagaaaaactccNgtcaggctc tccac |
| 447 | IGR2154a_1 | a/g | | Not yet verified | genomic | 389 | | acaacaacgggtaNatatttaggtctc |
| 448 | IGR2155a_1 | a/c | | Not yet verified | genomic | 398 | | attattagtcNaataatcacc |
| 449 | IGR2155a_2 | a/g | | Not yet verified | genomic | 619 | | aaggcggggtNcagtggctcac |
| 450 | IGR2156a_1 | a/c | | Not yet verified | genomic | 176 | | ctgaggcaggtggatcatNtgaggtcagg |
| 451 | IGR2157a_1 | a/c | | Verified | genomic | 254 | | tgaagagacatgcatNcaaaccatatc |
| 452 | IGR2159a_1 | other/ w+ | Poly t | Verified | genomic | 411 | | ttttttttttNccgtgaacag |
| 453 | IGR2160a_1 | other/ w+ | ca repeat | Verified | genomic | 601 | | acaggcgcgcNcacacacacacaca |
| 454 | IGR2160a_2 | a/g | | Not yet verified | genomic | 213 | | taaaaattattcgNgagaattttagaa |
| 455 | IGR2160a_3 | a/g | | Not yet verified | genomic | 287 | | ccaagtaccttggNctgtactgagagatga |
| 456 | IGR2162a_1 | a/c | | Not yet verified | genomic | 350 | | acaaacaaacaaNcaaaccttatt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 457 | IGR2162a_3 | t/c | | Not yet verified | genomic | 450 | | aaatatagNcaaatact |
| 458 | IGR2164a_1 | a/t | | Not yet verified | genomic | 557 | | tcctggccaacNtggtgaaacccc |
| 459 | IGR2165a_1 | ins/del | Poly a | Verified | genomic | 473 | | ggaaaaaaaaaNcacacatgat |
| 460 | IGR2165a_2 | ins/del | | Not yet verified | genomic | 271 | | ataaaaaaaaNgatttattatgt |
| 461 | IGR2166a_2 | a/c | | Not yet verified | genomic | 323 | | agtttcNgtttagaaag |
| 462 | IGR2167a_1 | t/c | c on ref. sequence | Verified | genomic | 324 | | acttaagagaNtcaataatttt |
| 463 | IGR2167a_2 | a/t | | Not yet verified | genomic | 207 | | ttttaaaacttNtaaaggaat |
| 464 | IGR2168a_1 | ins/del | | Not yet verified | genomic | 341 | | tgtttcttttttctttcttNttttttttagacggag |
| 465 | IGR2175a_1 | a/g | g in ref. sequence | Verified | genomic | 310 | | tggggccaaaaatctcNtctgacttccagtg |
| 466 | IGR2175a_2 | a/g | g in ref. sequence | Verified | genomic | 526 | | tcccaaggtcacatNgttactatgtatgtt |
| 467 | IGR2176a_1 | a/g | g in ref. sequence | Verified | genomic | 119 | | gaagcaagactgtcNggaacactggactc |
| 468 | IGR2176a_2 | a/g | | Not yet verified | genomic | 399 | | aaccatctgtttgtgtcNtgaggctctctgtat |
| 469 | IGR2177a_1 | a/c | c in ref. sequence | Verified | genomic | 325 | | tgatgatcacgcaacNcagctgaagaatgat |
| 470 | IGR2178a_1 | a/g | | Verified | genomic | 138 | | ccatcctaaatactacaagatgcNtttgacgctataaga |
| 471 | IGR2179a_1 | a/g | | Verified | genomic | 284 | | aaagtcaaaaaatcNaaaggagatgagca |
| 472 | IGR2179a_2 | other/w+ | Poly t | Verified | genomic | 371 | | ttctgggaaaaggaagtcNttttttttttt |
| 473 | IGR2179a_3 | ins/del | | Not yet verified | genomic | 470 | | taatctctgcctcccaggNtcaagtgattcttct |
| 474 | IGR2180a_1 | a/g | | Not yet verified | genomic | 65 | | gtatttttagtagagacNgggtttccttatgtt |
| 475 | IGR2180a_2 | g/c | | Verified | genomic | 383 | | tcaccagcaacctgttNtgagtgaatcatc |
| 476 | IGR2181a_1 | other/w+ | Poly t | Verified | genomic | 260 | | aaaaagttttttttttNctaccaaatgtacag |
| 477 | IGR2181a_2 | t/c | | Verified | genomic | 416 | | attacattataatttacaNgcatgatctaat |
| 478 | IGR2181a_3 | a/g | | Verified | genomic | 614 | | ccaagaaagaggNtgtcatgggtaa |
| 479 | IGR2181a_4 | a/c | | Verified | genomic | 83 | | gtggaggctgaNagtaggcgagttt |
| 480 | IGR2182a_1 | a/g | | Verified | genomic | 115 | | tgcctccaagaaagaggNtgtcatggggtaaacc |
| 481 | IGR2184a_1 | other/w+ | Poly t | Verified | genomic | 58 | | tcctttcattttagcctgaaaagactcccttttagcaNtttt |
| 482 | IGR2184a_4 | a/t | | Not yet verified | genomic | 448 | | tgccatgttggtNtgctgcaccc |
| 483 | IGR2184a_5 | ins/del | ins/del t | Verified | genomic | 380 | | tattttttttttttaagtacNttaagttctagggt |
| 484 | IGR2185a_2 | t/c | | Not yet verified | genomic | 420 | | gttctagatccNtgaggaatc |
| 485 | IGR2185a_3 | t/g | | Not yet verified | genomic | 453 | | ttccacaatggtNgaactagttt |
| 486 | IGR2186a_1 | a/t | | Not yet verified | genomic | 184 | | gttcatatactttNtcccctgttt |
| 487 | IGR2188a_1 | t/c | | Not yet verified | genomic | 549 | | tttgctgaagttgNttatcaacttaa |
| 488 | IGR2189a_1 | a/g | | Verified | genomic | 475 | | atatgatgcattacNtttatcgatttg |
| 489 | IGR2189a_2 | t/c | | Verified | genomic | 252 | | ccttgtcttgtgcNggttttcaa |
| 490 | IGR2190a_2 | t/c | | Not yet verified | genomic | 343 | | ttattgccNcaatttc |
| 491 | IGR2190a_4 | a/g | | Not yet verified | genomic | 326 | | ttggttgataNgctattaatta |
| 492 | IGR2191a_1 | a/g | | Not yet verified | genomic | 286 | | tgttgattttNgatgtttcc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 493 | IGR2191a_2 | t/c | | Not yet verified | genomic | 353 | | actgctttgaatgNgtcccagattc |
| 494 | IGR2191a_3 | a/g | | Not yet verified | genomic | 390 | | ttgtgtctttgttctcNttggtttcaaa |
| 495 | IGR2191a_4 | a/t | | Not yet verified | genomic | 498 | | gcggttttgaNtgagtttctt |
| 496 | IGR2192a_1 | t/c | | Not yet verified | genomic | 515 | | ttttttttgNtttccatttgc |
| 497 | IGR2192a_2 | t/c | | Verified | genomic | 506 | | cccctgcNttttttg |
| 498 | IGR2192a_3 | t/g | | Verified | genomic | 359 | | tttatgaatctgggNgctcctgtatt |
| 499 | IGR2193a_1 | t/g | | Verified | genomic | 361 | | ttcaggagctcttNtaaggcagg |
| 500 | IGR2193a_2 | t/g | | Verified | genomic | 376 | | ggcctggNggtgacaaaa |
| 501 | IGR2193a_3 | t/c | | Verified | genomic | 423 | | attttatttcNccttcacttat |
| 502 | IGR2194a_1 | a/g | | Verified | genomic | 57 | | cagagagatccNctgttagtctga |
| 503 | IGR2194a_2 | a/g | | Verified | genomic | 196 | | agagtatctttNtggtgttctctg |
| 504 | IGR2194a_3 | t/c | | Verified | genomic | 220 | | atttcctgaaNttgaatgttggcc |
| 505 | IGR2197a_a | other/ w+ | | Not yet verified | genomic | 498 | | gtctaactagtcccaNcgagatgagccgggt |
| 506 | IGR2198a_1 | g/c | | Verified | genomic | 233 | | cagtagacgaacNatgcaaaatacca |
| 507 | IGR2198a_3 | a/t | | Not yet verified | genomic | 98 | | tcctggggctttNacgtttttagtg |
| 508 | IGR2199a_1 | t/c | | Verified | genomic | 357 | | cagagataagaaNtagtttccaagaa |
| 509 | IGR2200a_1 | a/c | | Verified | genomic | 176 | | acaggcttNgacagaggacttgga |
| 510 | IGR2202a_1 | t/c | | Verified | genomic | 308 | | tcactaaattctagaaaNaaagattctaggcagt |
| 511 | IGR2202a_2 | a/t | | Not yet verified | genomic | 330 | | taggcagtgctgNtatttaaaaaatcat |
| 512 | IGR2202a_3 | a/g | | Verified | genomic | 528 | | caggactaaagtgaNctactctgaaaga |
| 513 | IGR2202a_4 | ins/ del | 12 bp deletion | Not yet verified | genomic | 622 | | tttttggacacacacaatgacactNcacttagagaagtgc |
| 514 | IGR2203a_1 | a/g | | Verified | genomic | 329 | | acaaacaaataaacaNtaaaacaaaacccaca |
| 515 | IGR2203a_2 | other/ w+ | Poly a | Verified | genomic | 216 | | cagagtgattctgtgttttNaaaaaaaaa |
| 516 | IGR2204a_1 | ins/ del | | Not yet verified | genomic | 584 | | acagcaaaggcctttNactgaaggactc |
| 517 | IGR2206b_1 | t/g | | Not yet verified | genomic | 520 | | aggggcggttgcagNagaagagctgggcc |
| 518 | IGR2207a_1 | a/c | | Verified | genomic | 428 | | ggttataataattttNcgttcatcagacctc |
| 519 | IGR2209a_1 | t/g | | Verified | genomic | 153 | | tgtggggaagggNctatagccaagat |
| 520 | IGR2209a_2 | g/c | | Verified | genomic | 234 | | gcactttcctcaaNctggagaccaccag |
| 521 | IGR2209a_3 | a/g | | Verified | genomic | 462 | | ggccatcagaatctcNagttgatcttctaa |
| 522 | IGR2210a_1 | g/c | | Verified | genomic | 297 | | tcctgctaaggNtctgtgaggccc |
| 523 | IGR2210a_2 | t/c | c on ref. sequence | Verified | genomic | 610 | | catctagggtgtaNgttccatgaggg |
| 524 | IGR2213a_1 | g/c | | Verified | genomic | 314 | | cggtacttgtggagcaNagaggtggctcccaa |
| 525 | IGR2214a_1 | a/t | a on ref. sequence | Verified | genomic | 318 | | taacccaccaggctccagaNgtgcctagaatcccag |
| 526 | IGR2215a_1 | a/g | | Verified | genomic | 198 | | agatctggagagattccccacNagagtccatatttcc |
| 527 | IGR2221a_1 | other/ w+ | | Not yet verified | genomic | 214 | | cagagactttgtctgagNaaaaaaaaaagaaaaa |
| 528 | IGR2221a_2 | a/t | | Verified | genomic | 261 | | gaaaaaaaggaaaaaNattagcatgttta |
| 529 | IGR2221a_3 | t/g | | Verified | genomic | 289 | | gctatcaatatcaaggcacttgagNgctctatggatat |
| 530 | IGR2221a_4 | ins/ del | | Not yet verified | genomic | 231 | | aaaaagaaaaaNaaagaaaa |
| 531 | IGR2221a_5 | t/c | | Not yet verified | genomic | 79 | | aaaaattagccaagtgNggtggcaggcac |
| 532 | IGR2222a_1 | a/g | g in ref. sequence | Verified | genomic | 446 | | gcacatggggcacaNggtcacactcacca |
| 533 | IGR2222a_2 | t/c | c on ref. sequence | Verified | genomic | 476 | | cagagtgccacgcaNagcccccggcat |
| 534 | IGR2223a_1 | ins/ del | | Not yet verified | genomic | 194 | | tttttggttccttccttattaaNatggtatctttgta |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 535 | IGR2223a_2 | other/w+ | at repeat | Not yet verified | genomic | 485 | | gcctcaaggNaagaatatt |
| 536 | IGR2224a_1 | a/g | | Verified | genomic | 300 | | ctccaaccatgccNccctctttctggggc |
| 537 | IGR2224a_2 | t/c | | Verified | genomic | 387 | | gagtcctagtaaattgacNaccaagtactaagac |
| 538 | IGR2224a_3 | t/c | | Verified | genomic | 389 | | cctagtaaattgactaNcaagtactaagaccaa |
| 539 | IGR2224a_4 | t/c | | Verified | genomic | 582 | | tgagggacatcacagNtgtctccagaaaggta |
| 540 | IGR2225a_1 | a/c | | Verified | genomic | 464 | | agtctcggtctcaNagtgcccatgctatt |
| 541 | IGR2226a_1 | a/g | g in ref. sequence | Verified | genomic | 204 | | taaagagaaagaaNcatttgtcctgatt |
| 542 | IGR2226a_2 | t/g | t on ref. sequence | Verified | genomic | 426 | | catgcttcctatggtctNgccaaaaggactgaa |
| 543 | IGR2226a_3 | t/c | | Verified | genomic | 524 | | ggaatgtgctgaaNgcatcatcagtgt |
| 544 | IGR2226a_4 | t/c | | Verified | genomic | 272 | | taagaggtagtatcaNgtacaaaagtattct |
| 545 | IGR2228a_1 | g/c | g on ref. sequence | Verified | genomic | 450 | | gatattcacagtatagtgNggaagaccaacatta |
| 546 | IGR2229a_1 | t/g | t on ref. sequence | Verified | genomic | 298 | | ttttctgttgttgttNttttttttccatcac |
| 547 | IGR2230a_1 | t/c | | Verified | genomic | 608 | | catactttagccaNttagggtgtatt |
| 548 | IGR2233a_1 | g/c | g on ref. sequence | Verified | genomic | 597 | | tgtgaaaccttgggNaagttatttaa |
| 549 | IGR2234a_1 | a/g | | Verified | genomic | 362 | | taatcccagcaactcNggaggctgagaca |
| 550 | IGR2234a_2 | g/c | g on ref. sequence | Verified | genomic | 395 | | gaatctcttgaacctgNgaggcagaggttgca |
| 551 | IGR2235a_1 | t/c | | Verified | genomic | 153 | | gtgttctcacatgtgNcatgtggccaagga |
| 552 | IGR2235a_2 | t/g | | Verified | genomic | 386 | | agttaaaagctttaNaattatacaaat |
| 553 | IGR2236a_1 | a/g | | Verified | genomic | 256 | | ttacctagtcaaccggNtcacagatacattca |
| 554 | IGR2236a_2 | ins/del | | Not yet verified | genomic | 321 | | atttgaattacggagtcagatNttggctcttcttact |
| 555 | IGR2236a_3 | t/c | | Verified | genomic | 441 | | gaagggccaggcacaNgcttcttcctcagtgc |
| 556 | IGR2237a_1 | a/g | | Verified | genomic | 395 | | agcaaggcctctaacNcttgctcctaaaaatc |
| 557 | IGR2237a_3 | a/g | | Verified | genomic | 619 | | tgggccaatgaccccNggtctcttttgtgac |
| 558 | IGR2238a_1 | a/g | | Verified | genomic | 92 | | cctgctctgctcNggttccacccctg |
| 559 | IGR2238a_2 | a/c | | Verified | genomic | 115 | | accctgggccaatgaNccccgggtcctttt |
| 560 | IGR2238a_3 | ins/del | | Not yet verified | genomic | 247 | | gctcccactctactattNactcttccaacct |
| 561 | IGR2238a_4 | a/g | | Not yet verified | genomic | 442 | | tggatctggctNcgcctgcctaaaca |
| 562 | IGR2239a_1 | a/c | | Not yet verified | genomic | 256 | | ctgcttctccgcactgNtgggcagtgtggg |
| 563 | IGR2240a_1 | t/c | | Verified | genomic | 545 | | agtgctcattttgagaNaggccccagagcat |
| 564 | IGR2242a_1 | t/g | | Not yet verified | genomic | 119 | | gtgggtttaagattNgggtcacgagtcta |
| 565 | IGR2243a_1 | a/c | c in ref. sequence | Verified | genomic | 256 | | tgccccctgtatNgaagagaggc |
| 566 | IGR2244a_1 | other/w+ | Poly t | Verified | genomic | 220 | | ttttttttttNggctccctgaccc |
| 567 | IGR2244a_2 | g/c | c on ref. sequence | Not yet verified | genomic | 73 | | ccaccagcctggNtaattttgt |
| 568 | IGR2244a_3 | t/c | t on ref. sequence | Verified | genomic | 469 | | gaggttcaagNtccaggtctct |
| 569 | IGR2244a_4 | t/c | | Verified | genomic | 576 | | tgagggctctcNcatcttctaaga |
| 570 | IGR2245a_2 | a/g | | Verified | genomic | 145 | | aggacaatgggNagggagtgggag |
| 571 | IGR2245a_3 | a/g | g in ref. sequence | Verified | genomic | 397 | | attacaggcacccNccaccacgcaggg |
| 572 | IGR2245a_4 | t/g | | Verified | genomic | 434 | | attttagcggaNacgaggtttcacca |
| 573 | IGR2245a_5 | t/c | | Verified | genomic | 574 | | tgtctgtccaNaggctggacag |
| 574 | IGR2245a_6 | ins/del | Poly t | Verified | genomic | 261 | | ttttttttttNgagacggag |
| 575 | IGR2246a_1 | ins/del | | Verified | genomic | 629 | | ccaccacgccctgccaNtatttattta |
| 576 | IGR2248a_1 | t/g | t on ref. sequence | Verified | genomic | 145 | | ctagatcagtgNtcagcaggccag |
| 577 | IGR2249a_1 | a/g | a in ref. sequence | Verified | genomic | 289 | | aactgaaNgttccaatttcct |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 578 | IGR2250a_1 | t/c | | Verified | genomic | 145 | | ggctcagcaccaacaNccagcagggctt |
| 579 | IGR2250a_2 | t/c | t on ref. sequence | Verified | genomic | 253 | | ttcttgctgctgcaNtggggccttca |
| 580 | IGR2250a_3 | t/g | t on ref. sequence | Verified | genomic | 302 | | acaccctaggctcacNgagaggcctcc |
| 581 | IGR2250a_4 | t/c | c on ref. sequence | Verified | genomic | 389 | | tatcaatgagggctaNtcactggctacttac |
| 582 | IGR2251a_1 | g/c | c on ref. sequence | Verified | genomic | 269 | | taatcccagctttgNaggcagaagcagg |
| 583 | IGR2251a_2 | a/t | | Verified | genomic | 360 | | aaacacaaaaattNgctgggcgtcgtgg |
| 584 | IGR2251a_3 | a/g | g in ref. sequence | Verified | genomic | 392 | | cagctactcggagNctgaggcaggag |
| 585 | IGR2251a_4 | g/c | | Verified | genomic | 436 | | aggcgaagattgcaNtgagcgaagaacg |
| 586 | IGR2251a_5 | other/ w+ | Poly a | Verified | genomic | 526 | | tgacagagggagactctgtctctcctNaaaaaa |
| 587 | IGR2252a_1 | a/g | | Verified | genomic | 323 | | cccaactagagtaaNtcctggacacacag |
| 588 | IGR2252a_2 | t/c | | Verified | genomic | 405 | | tggccatcaggaNgggaggccagactg |
| 589 | IGR2253a_1 | a/g | g in ref. sequence | Verified | genomic | 246 | | ccggctccagcccNagcgccgagaa |
| 590 | IGR2254a_1 | t/g | | Verified | genomic | 68 | | agcgcggcctggggtcNgggaacgcgg |
| 591 | IGR2255a_1 | a/c | | Not yet verified | genomic | 477 | | ttctagtagccNtattaataaaatt |
| 592 | IGR2255a_2 | a/g | | Verified | genomic | 217 | | gaggctgggagctNtgactttttcatt |
| 593 | IGR2255a_3 | other/ w+ | Poly a | Verified | genomic | 387 | | tcagaagctaactggNaaaaaaaa |
| 594 | IGR2256a_1 | t/c | | Verified | genomic | 510 | | atcatagtcaccgcagNcctgaactcctaagctt |
| 595 | IGR2256a_2 | other/ w+ | Poly a | Verified | genomic | 344 | | ttctcaggatttgNaaaaaa |
| 596 | IGR2256a_3 | a/g | | Verified | genomic | 179 | | tgaaattaactttaNtggtatatttaa |
| 597 | IGR2257a_1 | a/g | g in ref. sequence | Verified | genomic | 423 | | atataatgtgttgNgtaaagaatat |
| 598 | IGR2257a_2 | t/c | t on ref. sequence | Verified | genomic | 508 | | cagcagattttttaaNaaggaaatctaa |
| 599 | IGR2257a_3 | g/c | | Verified | genomic | 621 | | ctattcttacttcNtgaagatggatgg |
| 600 | IGR2258a_1 | other/ w+ | Poly t | Verified | genomic | 575 | | tgcaNttttttt |
| 601 | IGR2259a_1 | other/ w+ | Poly t | Verified | genomic | 234 | | gctaNtttttttg |
| 602 | IGR2260a_1 | t/c | | Not yet verified | genomic | 582 | | tcaaacaataNgttaaattaa |
| 603 | IGR2261a_1 | t/c | | Verified | genomic | 608 | | ggctgaggagggNggatcacc |
| 604 | IGR2262a_1 | ins/ del | Poly a | Verified | genomic | 332 | | aagactccgtctcNaaaaaa |
| 605 | IGR2262a_3 | a/g | a in ref. sequence | Verified | genomic | 425 | | ttcagagcNtctgtccag |
| 606 | IGR2263b_1 | g/c | g on ref. sequence | Verified | genomic | 411 | | ttcaagtgattctNctgtctcagcctcc |
| 607 | IGR2264a_1 | other/ w+ | | Verified | genomic | 318 | | taatagctgttttttNtgccaaaatcactgt |
| 608 | IGR2265a_1 | t/c | c on ref. sequence | Verified | genomic | 249 | | ccccacaattNggcttcaa |
| 609 | IGR2265a_2 | t/c | t on ref. sequence | Verified | genomic | 340 | | gtagtagaaaNgtaaatt |
| 610 | IGR2269a_1 | a/g | | Not yet verified | genomic | 270 | | tatgtacaagtatctNtttgagtacttgct |
| 611 | IGR2272a_1 | a/t | | Verified | genomic | 540 | | ttttaaaaaaaaaaaNttttaaggcatagga |
| 612 | IGR2272a_2 | t/c | | Verified | genomic | 163 | | cttcttggaaggctgNggcaggaagatgc |
| 613 | IGR2272a_3 | a/g | g in ref. sequence | Verified | genomic | 384 | | taccaaaaatacaaaaaattagccNggcgttgtgg |
| 614 | IGR2272a_4 | t/c | | Verified | genomic | 395 | | ttagccgggcgttgtgNgggcacctgtagtaccc |
| 615 | IGR2272a_5 | g/c | | Not yet verified | genomic | 462 | | ttgtgaaccccggaggcggaNgttgcaatgagtggagatt |
| 616 | IGR2273a_1 | other/ w+ | Poly t | Verified | genomic | 388 | | cccctatccacagNtttttttttt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 617 | IGR2274a_1 | t/g | | Verified | genomic | 311 | | tctccatgtcaccgcaNtcacatttgtgtgtgg |
| 618 | IGR2274a_2 | g/c | | Verified | genomic | 381 | | tcattagcctggcttNcattctcttctgaac |
| 619 | IGR2274a_3 | t/c | c on ref. sequence | Verified | genomic | 539 | | atactactatggNcctttgcttccg |
| 620 | IGR2276a_1 | t/c | c on ref. sequence | Verified | genomic | 113 | | cactactcatcttcNtgagcacaaaag |
| 621 | IGR2276a_2 | a/c | c in ref. sequence | Verified | genomic | 359 | | aaatgagtagccttcNtttgagagacagag |
| 622 | IGR2277a_1 | a/g | a in ref. sequence | Verified | genomic | 143 | | gatcatctcaaggttcNcaaaatcaagct |
| 623 | IGR2277a_2 | other/w+ | Poly t | Verified | genomic | 485 | | gatgcaagaaNtttttttttttttt |
| 624 | IGR2279a_1 | a/g | a in ref. sequence | Verified | genomic | 165 | | acaggcatccaccaccNtgccctggtaatttt |
| 625 | IGR2279a_2 | t/c | c on ref. sequence | Verified | genomic | 256 | | catgtgatctgccNgcctcagccttccaaa |
| 626 | IGR2279a_3 | other/w+ | Poly t | Verified | genomic | 310 | | ccaatgcgcctggccNtttttt |
| 627 | IGR2279a_4 | g/c | | Verified | genomic | 108 | | cctctgcctcccaggttNaagcagttctcctg |
| 628 | IGR2279a_5 | t/c | | Verified | genomic | 277 | | gccttccaaagtgcNaggattacaggt |
| 629 | IGR2281a_1 | a/c | | Verified | genomic | 144 | | cattcttgcattaNtataaagaaatac |
| 630 | IGR2281a_2 | other/w+ | Poly t | Verified | genomic | 87 | | aaattaattttttcttccNtttttttt |
| 631 | IGR2281a_3 | a/t | | Not yet verified | genomic | 72 | | taattttttaaatNaattttttcttc |
| 632 | IGR2283a_2 | ins/del | ins/del 2bp | Verified | genomic | 574 | | cctggctctctNttagttatt |
| 633 | IGR2284a_1 | t/c | t on ref. sequence | Verified | genomic | 486 | | gccttcactttccaNatcaccatcagc |
| 634 | IGR2284a_2 | t/c | | Not yet verified | genomic | 536 | | tgccaagtactattNtaacttctgagaatac |
| 635 | IGR2285a_1 | a/c | | Verified | genomic | 171 | | gaaaaatgaagcNggagaaaaatgaa |
| 636 | IGR2286a_1 | a/c | | Not yet verified | genomic | 261 | | tgtctacatgcNagacaatca |
| 637 | IGR2287a_1 | t/c | t on ref. sequence | Verified | genomic | 107 | | ctttgggaggcNgaggcaggcaga |
| 638 | IGR2287a_2 | other/w+ | Poly a | Verified | genomic | 188 | | gtgaaacccgttctctactaaaaaatacNaaaaaaaaa |
| 639 | IGR2287a_3 | other/w+ | Poly a | Verified | genomic | 351 | | acagagcgagactccgtctctNaaaaaaaaa |
| 640 | IGR2287a_4 | t/c | | Verified | genomic | 463 | | ttgtaaggacttgggNtttcaaaaaatctg |
| 641 | IGR2287a_7 | t/c | | Verified | genomic | 463 | | tatagaccattgNaaggacttggg |
| 642 | IGR2288a_1 | t/c | t on ref. sequence | Verified | genomic | 170 | | atggcaaaagaNtttattgaca |
| 643 | IGR2288a_2 | a/g | a in ref. sequence | Verified | genomic | 198 | | ggatgtggagtacNagaggaagagcagcc |
| 644 | IGR2289a_1 | a/g | g in ref. sequence | Verified | genomic | 215 | | cccaagtagctgggactNcaggtgtgtgccacca |
| 645 | IGR2291a_1 | g/c | c on ref. sequence | Verified | genomic | 153 | | ctgtaatcctagctacttNggaggctgaggcatga |
| 646 | IGR2291a_2 | a/g | | Not yet verified | genomic | 548 | | tagcaagaagtNggagggaggtt |
| 647 | IGR2292a_1 | a/c | | Verified | genomic | 256 | | gtctcatgtNatccccacc |
| 648 | IGR2292a_2 | t/c | c on ref. sequence | Verified | genomic | 589 | | tctatttatctcttNaatttcctatt |
| 649 | IGR2292a_3 | a/t | | Verified | genomic | 282 | | atggaatgttatcNtccctctttacaga |
| 650 | IGR2293a_3 | ins/del | gt repeat | Verified | genomic | 437 | | tgtgtgtgtNgtgtgtgtgtttgtg |
| 651 | IGR2294a_1 | t/c | c on ref. sequence | Verified | genomic | 390 | | cctggaaaaaNgggacactcc |
| 652 | IGR2294a_2 | t/c | | Verified | genomic | 440 | | ttagcaaatggNacaccagga |
| 653 | IGR2294a_3 | t/g | | Verified | genomic | 481 | | tcgacagatccNatgtccatgga |
| 654 | IGR2295a_1 | ins/del | | Not yet verified | genomic | 438 | | atttgctgttcNgcaatatttgct |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 655 | IGR2295a_2 | a/g | | Verified | genomic | 535 | | tgcagctgagggNcctcactggtagaa |
| 656 | IGR2297a_1 | g/c | g on ref. sequence | Verified | genomic | 65 | | taactcaagaaNattagagaaa |
| 657 | IGR2297a_2 | t/c | c on ref. sequence | Verified | genomic | 198 | | aaaacactcNtcaggata |
| 658 | IGR2297a_3 | t/g | g on ref. sequence | Verified | genomic | 487 | | ttcttaaagaaaaNaattttcaaccca |
| 659 | IGR2297a_4 | t/c | c on ref. sequence | Verified | genomic | 588 | | gattttgtcaccacNaggcctgccctaaaaga |
| 660 | IGR2297a_5 | a/c | c in ref. sequence | Verified | genomic | 446 | | ccctacaagccNgaagagag |
| 661 | IGR2298a_1 | a/g | g in ref. sequence | Not yet verified | genomic | 293 | | tttaaatgtaaatggNctaaatgctcca |
| 662 | IGR2299a_1 | a/g | g in ref. sequence | Not yet verified | genomic | 592 | | caaagacacaacNtgccagaatct |
| 663 | IGR2300a_2 | t/c | | Verified | genomic | 606 | | ccaataacaggNtctgaaattg |
| 664 | IGR2303a_1 | t/c | c on ref. sequence | Verified | genomic | 189 | | ttttgtatctacNggcaaaatata |
| 665 | IGR2303a_2 | g/c | g on ref. sequence | Verified | genomic | 495 | | aatatctcattagNataatgagccc |
| 666 | IGR2304a_1 | t/c | | Verified | genomic | 483 | | cttggatgttNgaatggcat |
| 667 | IGR2304a_2 | a/g | | Verified | genomic | 667 | | ggttgagtgtgacaNtacagggtaaaaa |
| 668 | IGR2305a_1 | a/t | | Verified | genomic | 253 | | tttctggataggaatNctgcatataatcatttggt |
| 669 | IGR2308a_1 | t/c | c on ref. sequence | Verified | genomic | 339 | | tttgtatcctttgtaagaaacNgctagtggcca |
| 670 | IGR2308a_2 | a/g | | Verified | genomic | 561 | | taggtattgtcaaaattgNactgcattataggaca |
| 671 | IGR2309a_2 | t/g | | Verified | genomic | 610 | | gatgtgttttttttNtgggagacgg |
| 672 | IGR2310a_1 | ins/del | | Not yet verified | genomic | 273 | | aattttgtattttNtagtagagatggggt |
| 673 | IGR2311a_1 | a/g | g in ref. sequence | Verified | genomic | 181 | | gcccagtctgagtgcNgtggcatgatgttgg |
| 674 | IGR2311a_2 | a/c | c in ref. sequence | Verified | genomic | 207 | | ttggctcactgcaaNctccacctcccggg |
| 675 | IGR2311a_3 | ins/del | | Not yet verified | genomic | 525 | | caacctctgcctcctgggtNgcagttctcctgcct |
| 676 | IGR2313a_1 | other/w+ | poly A | Not yet verified | genomic | 499 | | aaaaaaaNcaactaag |
| 677 | IGR2313a_2 | a/g | | Not yet verified | genomic | 370 | | taaccaggNtgtttcaggg |
| 678 | IGR2313a_3 | a/g | | Not yet verified | genomic | 335 | | aaatgggggNtgggaggaca |
| 679 | IGR2313a_4 | t/c | | Not yet verified | genomic | 531 | | cagattaaaNcagtaaatt |
| 680 | IGR2313a_5 | ins/w+ | C insert | Not yet verified | genomic | 391 | | agttttggcNatgatagg |
| 681 | IGR2314a_1 | ins/w+ | varying number of GT repeats | Verified | genomic | 560 | | atgttttcaNgtgtgtgtgt |
| 682 | IGR2315a_1 | a/g | | Not yet verified | genomic | 369 | | cttccattgcNaagagtttgc |
| 683 | IGR2315a_2 | t/c | | Not yet verified | genomic | 533 | | tatttcttaNgcctgtcttt |
| 684 | IGR2315a_3 | a/g | G in ref | Not yet verified | genomic | 211 | | aacatgccNctgaaaca |
| 685 | IGR2316a_1 | a/g | G in ref | Not yet verified | genomic | 499 | | cccaggcttNttaggatga |
| 686 | IGR2316a_2 | t/c | G in ref | Not yet verified | genomic | 565 | | aaaccctgNtcctgataa |
| 687 | IGR2316a_3 | a/g | | Not yet verified | genomic | 469 | | tgaaataaNccccccagtc |
| 688 | IGR2321a_1 | t/c | | Not yet verified | genomic | | | ttgtgaaaaNgtcaaatag |
| 689 | IGR3000a_1 | a/g | a in ref. sequence | Verified | genomic | 224 | | ttttagaaNtgatactttt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 690 | IGR3000a_2 | a/g | | Verified | genomic | 558 | | ttaagaaatatgtNtttctattactatc |
| 691 | IGR3002a_1 | g/c | g on ref. sequence | Verified | genomic | 146 | | ctgggcagNgttcgcaa |
| 692 | IGR3002a_2 | a/g | | Verified | genomic | 511 | | atattgaacNacatagat |
| 693 | IGR3003a_1 | a/g | | Verified | genomic | 494 | | tgaaacccNtctctactt |
| 694 | IGR3004a_2 | t/c | c on ref. sequence | Verified | genomic | 430 | | gagtggaactctcacNgccagatttcctc |
| 695 | IGR3004a_3 | ins/del | | Verified | genomic | 285 | | attttctctctctcttNttttctctttcct |
| 696 | IGR3005a_1 | t/c | t on ref. sequence | Verified | genomic | 494 | | aggagtagNttagatagaa |
| 697 | IGR3005a_2 | g/c | c on ref. sequence | Verified | genomic | 538 | | agtagcacNactaccca |
| 698 | IGR3005a_3 | a/c | c in ref. sequence | Verified | genomic | 34 | | cccatgaaggcaccaaNtcaactgcccagt |
| 699 | IGR3006a_1 | other | gt repeat | Verified | genomic | 234 | | ccagttctgacgatcatcNtgtgtgtgtg |
| 700 | IGR3006a_2 | t/g | | Verified | genomic | 227 | | cagttctgacNatcatcgt |
| 701 | IGR3007a_1 | t/c | | Verified | genomic | 458 | | cgtgaagccaNcgcccca |
| 702 | IGR3007a_2 | other/w+ | Poly t | Verified | genomic | 176 | | aaatactgtaccctgtgacNttttt |
| 703 | IGR3008a_1 | t/c | | Verified | genomic | 147 | | cacttattaNttaccata |
| 704 | IGR3008a_2 | a/c | | Verified | genomic | 339 | | tgcatgcaaNtctctactt |
| 705 | IGR3008a_3 | t/c | C in ref sequence | Verified | genomic | 342 | | atgcaactcNcacttcacc |
| 706 | IGR3013a_1 | other | gt repeat | Verified | genomic | 637 | | cacatttatatatgcNtgtgtgtgt |
| 707 | IGR3016a_1 | a/g | a in ref. sequence | Verified | genomic | 636 | | ctgctggtacagctNtgttgttcattttgc |
| 708 | IGR3018a_1 | a/g | g in ref. sequence | Verified | genomic | 238 | | gggcactgacacccNcctgtgtggggccc |
| 709 | IGR3018a_2 | t/g | | Verified | genomic | 191 | | gggcacctgtgttcNtgatcgtttccttta |
| 710 | IGR3019a_1 | a/g | | Verified | genomic | 205 | | ttgtgttagaaaattttgcccNattgtaggctaatgta |
| 711 | IGR3019a_2 | a/g | | Verified | genomic | 388 | | cagctttattgaagaNgcaatgttacag |
| 712 | IGR3020a_1 | g/c | g on ref. sequence | Verified | genomic | 172 | | gtcttctgccctggctNtgttttagctggtcc |
| 713 | IGR3020a_2 | a/c | c in ref. sequence | Verified | genomic | 349 | | cttacttagcctagaNaacaaattataag |
| 714 | IGR3020a_3 | a/g | a in ref. sequence | Verified | genomic | 542 | | tataggaactacNataatgttaggtca |
| 715 | IGR3022a_1 | a/t | t on ref. sequence | Verified | genomic | 267 | | gctggagagcttgNctcatactgagcag |
| 716 | IGR3023a_1 | g/c | c on ref. sequence | Verified | genomic | 79 | | tctccttagggcaNagtgagcaggctccc |
| 717 | IGR3023a_2 | ins/del | ct repeat | Verified | genomic | 264 | | attctctctctctctNtctctctgatag |
| 718 | IGR3023a_3 | t/g | g on ref. sequence | Verified | genomic | 368 | | ggcatgatcatatagcNcactgtaatcttg |
| 719 | IGR3023a_4 | t/c | t on ref. sequence | Verified | genomic | 580 | | gggattacaggtgtgaaNcaccatacctggctaa |
| 720 | IGR3029a_1 | a/g | A in ref sequence | Verified | genomic | 201 | | ctggaggtNcacagacagg |
| 721 | IGR3029a_2 | a/g | A in ref sequence | Verified | genomic | 498 | | agtccaagNacaaagct |
| 722 | IGR3030a_1 | t/c | T in ref sequence | Verified | genomic | 181 | | attcatgcNtgcctttt |
| 723 | IGR3032a_1 | a/g | A in ref sequence | Verified | genomic | 158 | | actagggaNgccaaggc |
| 724 | IGR3032a_2 | g/c | C in ref sequence | Verified | genomic | 281 | | gtaatcccaNctattcggg |
| 725 | IGR3035a_2 | a/g | G in ref sequence | Verified | genomic | 223 | | gtcaggggaNtgatggaaa |
| 726 | IGR3036a_1 | a/g | | Verified | genomic | 187 | | aaatacaNtaaaataa |
| 727 | IGR3037a_1 | a/c | | Verified | genomic | 521 | | gggagaaccNtcaccag |
| 728 | IGR3038a_2 | t/c | | not yet verified | genomic | 464 | | aaatacagaaaNacttttgtgtt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 729 | IGR3039a_1 | a/g | G in ref sequence | Verified | genomic | 387 | | gggccagaggNtggaagcgaag |
| 730 | IGR3040a_2 | t/c | | Verified | genomic | 517 | | cccgctcacaNaggggagg |
| 731 | IGR3040a_3 | t/c | | Verified | genomic | 133 | | acctgagaaNccaacacaacga |
| 732 | IGR3041a_1 | t/c | T in ref sequence | Verified | genomic | 331 | | tcgtcacaNggaagat |
| 733 | IGR3042a_1 | a/g | | Verified | genomic | 435 | | caccctagaNatgatgggaa |
| 734 | IGR3043a_1 | t/c | | Verified | genomic | 278 | | ataggcccagtgatggNgggctggcactgaact |
| 735 | IGR3044a_1 | t/c | | Verified | genomic | 477 | | caggcatcaatgcagaNttagtgtttttcaggg |
| 736 | IGR3044a_2 | t/c | | Verified | genomic | 513 | | ctctggcagacttttttcNctgtcacatcctccca |
| 737 | IGR3045a_1 | t/g | | Verified | genomic | 137 | | aagcatggagcagtgtacNcaaggaccttgtggaaata |
| 738 | IGR3046a_1 | a/g | | Verified | genomic | 293 | | tgtggcccagtgcctNgcccagggtccaagcc |
| 739 | IGR3047a_1 | t/g | | Verified | genomic | 455 | | cagactctcctccccctNggccaggatattgcctttgt |
| 740 | IGR3047a_2 | a/g | | Verified | genomic | 522 | | ttgactggcctgtgccNggactggggagagtaa |
| 741 | IGR3047a_3 | t/c | | Verified | genomic | 609 | | gtgatgctcctactcNgctcgcattacatagca |
| 742 | IGR3049a_1 | t/c | | Verified | genomic | 437 | | tttatatcacacctNattctgcagcagacaga |
| 743 | IGR3049a_2 | t/c | | Verified | genomic | 611 | | gtccacgggcctgcctgNttgccagacggggctcca |
| 744 | IGR3050a_1 | t/c | | Verified | genomic | 224 | | ttctgaatactgagatcNgaaagaagtgtctcc |
| 745 | IGR3051a_1 | a/t | | Verified | genomic | 667 | | tttagagatagaaaggaaNggaaggctgttagat |
| 746 | IGR3053a_1 | a/g | | Verified | genomic | 364 | | ggggtccttttagaaaNggcttttcttaggaa |
| 747 | IGR3053a_2 | t/c | | Verified | genomic | 481 | | gttaacagtgacatggNgggcccagtgggagaca |
| 748 | IGR3054a_1 | other/ w+ | poly A | Verified | genomic | 597 | | cctagtgaattggtNaaaaaaaaa |
| 749 | IGR3055a_1 | t/c | | Verified | genomic | 375 | | cccctcctcaccatNctccagcagaaggacag |
| 750 | IGR3055a_2 | other/ w+ | Poly a | Verified | genomic | 133 | | aaaaaaaaaaaaNttgcttaatcatt |
| 751 | IGR3056a_1 | a/g | | Verified | genomic | 328 | | cttcaaaaagatgacaNtaatacctgctcctagg |
| 752 | IGR3056a_2 | a/g | | Verified | genomic | 383 | | aaatatcagtggagcNtcgacacattacaggcc |
| 753 | IGR3057a_1 | t/g | | Verified | genomic | 549 | | ttagcagtcactcctcattcNctacttcctctagccctg |
| 754 | IGR3059a_1 | a/t | | Not yet verified | genomic | 94 | | tatatatatatatatNtatttcacggtttgggtcta |
| 755 | IGR3059a_2 | other/ w+ | at repeat | Verified | genomic | 63 | | caacaacNtatatatatatata |
| 756 | IGR3060a_1 | g/c | | Verified | genomic | 102 | | tccacttgttaaggNcttctggaatttctttt |
| 757 | IGR3061a_1 | t/c | | Verified | genomic | 362 | | tttcaattattgtataNttttactccagaagt |
| 758 | IGR3061a_2 | t/c | | Verified | genomic | 592 | | caatattgtcatcaNacttttaaaagcatgacttc |
| 759 | IGR3062a_2 | t/c | | Verified | genomic | 139 | | ttgaacatatttataaNggctgcctatgccttaa |
| 760 | IGR3064a_1 | t/c | | Verified | genomic | 616 | | cttgccaaggtatagtNgactttcttgaataaa |
| 761 | IGR3065a_1 | a/g | | Verified | genomic | 358 | | tttatccattttaaatcaNgttgtcttttattgctgag |
| 762 | IGR3066a_1 | a/t | | Verified | genomic | 351 | | tctggaagttgccgcctgNacctgccctccagtcttg |
| 763 | IGR3068a_1 | t/c | | Not yet verified | genomic | 337 | | gaagttcccNgttagcaggg |
| 764 | IGR3072a_1 | ins/ del | caaa repeat | Verified | genomic | 383 | | caaacaaacaaacaaacaaaNaactagccgggcatg |
| 765 | IGR3072a_2 | a/t | t on ref. sequence | Verified | genomic | 578 | | taaaataaaataaaaNaaaacgaaaaataattt |
| 766 | IGR3078a_1 | a/g | | Verified | genomic | 313 | | gggcagggagtggNcaagcactagag |
| 767 | IGR3079a_1 | a/g | | Not yet verified | genomic | 120 | | cctccgaataaagtcaNctcctcagtatac |
| 768 | IGR3081a_1 | t/g | t on ref. sequence | Verified | genomic | 317 | | gagtcctattctttcNggggtgcacacccg |
| 769 | IGR3081a_2 | a/g | | Verified | genomic | 286 | | gaaacgacccagNaatgcgcctcgcg |
| 770 | IGR3083a_1 | g/c | g on ref. sequence | Not yet verified | genomic | 397 | | gctcgggccgcgtNgccccgggcccagacccca |
| 771 | IGR3084a_1 | t/c | t on ref. sequence | Verified | genomic | 504 | | cggcaggctgNcagagcttt |
| 772 | IGR3086a_1 | a/t | | Verified | genomic | 234 | | ttgagatggttNttggcgatgacc |
| 773 | IGR3087a_1 | other/ w+ | Poly t | Verified | genomic | 325 | | ggaacaatctcNttttt |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 774 | IGR3087a_2 | ins/del | | Verified | genomic | 90 | | ttccagattNgcacataa |
| 775 | IGR3087a_3 | t/c | | Verified | genomic | 185 | | gtatgtaaaNctctatctg |
| 776 | IGR3088a_1 | other/w+ | Poly t | Verified | genomic | 108 | | tgataagtctgcNtttttttt |
| 777 | IGR3088a_2 | a/t | t on ref. sequence | Verified | genomic | 269 | | gcaaacaccNccacaccca |
| 778 | IGR3089a_1 | a/g | | Verified | genomic | 559 | | ctagaacaaaaaNgtaagaaaaaa |
| 779 | IGR3090a_1 | g/c | | Verified | genomic | 558 | | agttgctaNaacatctgt |
| 780 | IGR3095a_1 | other/w+ | Poly a | Verified | genomic | 257 | | actccgtctcNaaaaaaaaaaa |
| 781 | IGR3095a_2 | a/t | | Not yet verified | genomic | 178 | | aaattgctttNacccggaggc |
| 782 | IGR3096a_1 | t/c | t on ref. sequence | Verified | genomic | 316 | | cctggagaaNagctgagaa |
| 783 | IGR3096a_2 | a/g | | Verified | genomic | 406 | | aggtggcacNgatctctaaa |
| 784 | IGR3096a_3 | t/c | | Verified | genomic | 424 | | aaagctgtccNgctgcca |
| 785 | IGR3097a_1 | a/g | | Verified | genomic | 338 | | agaaatcatgagagcagNaaagggagaaaggg ta |
| 786 | IGR3097a_2 | a/c | | Verified | genomic | 472 | | acaacaacaacaaNaaaaaagagctcaaatgg |
| 787 | IGR3098a_1 | a/t | | Verified | genomic | 373 | | gtcttttgtaaaaacNacaaatttattata |
| 788 | IGR3100a_1 | t/c | | Verified | genomic | 243 | | ggcaggcggatcaNgaggtcaagagatccaga |
| 789 | IGR3103a_1 | t/c | | Verified | genomic | 326 | | aaggggcNgacatggc |
| 790 | IGR3105a_1 | t/c | | Verified | genomic | 231 | | agtggtgNgatcttgg |
| 791 | IGR3105a_2 | a/g | | Verified | genomic | 575 | | ttaccatNtaacccaa |
| 792 | IGR3105a_3 | ins/w+ | CA repeat | Verified | genomic | 187 | | tgtgtgNagacagaatcttg |
| 793 | IGR3108a_1 | t/c | | Verified | genomic | 348 | | ggttcccNggccagg |
| 794 | IGR3110a_1 | ins/w+ | GAA repeat or deletion | Verified | genomic | 59 | | ggaaagaNgaagaag |
| 795 | IGR3111a_1 | a/g | | Verified | genomic | 199 | | cttgaggNgtggtgcct |
| 796 | IGR3112a_1 | t/c | | Verified | genomic | 72 | | ttactttgNccagcttcc |
| 797 | IGR3113a_1 | g/c | G in ref | Not yet verified | genomic | 321 | | aatggatNtatgtcaga |
| 798 | IGR3113a_2 | a/t | T in ref | Not yet verified | genomic | 368 | | agggacccNaatagttt |
| 799 | IGR3113a_3 | t/g | T in ref | Not yet verified | genomic | 477 | | attcagaNgtgctgt |
| 800 | IGR3114a_1 | a/g | | Verified | genomic | 571 | | cacaagttNtccacagag |
| 801 | IGR3115a_1 | other/w+ | poly t | Verified | genomic | 557 | | gaatgatgcNtttttttttt |
| 802 | IGR3117a_1 | t/c | | Verified | genomic | 452 | | cccaaatgNtaccttat |
| 803 | IGR3118a_1 | t/c | C in ref | Not yet verified | genomic | 116 | | tggcataNagaaggtt |
| 804 | IGR3119a_1 | a/c | | Verified | genomic | 301 | | gcctagatcNcttgcttgca |
| 805 | IGR3119a_2 | a/c | | Verified | genomic | 534 | | ggccatggtNtatggcc |
| 806 | IGR3121a_1 | g/c | G in ref | Not yet verified | genomic | 586 | | agtactggNaccctgggc |
| 807 | IGR3122a_1 | t/g | G in ref | Not yet verified | genomic | 144 | | catggtcNactacact |
| 808 | IGR3122a_2 | a/g | | Verified | genomic | 441 | | gtaccagcNgctagtgga |
| 809 | IGR3125a_1 | del/w+ | del of ACTGT from ref | Verified | genomic | 3121 | | aaatgggNactgtctcg |
| 810 | IGR3125a_2 | a/c | C in ref | Not yet verified | genomic | 384 | | ggcaaacNcaccacg |
| 811 | IGR3129a_1 | t/c | | Verified | genomic | 193 | | cctgtggaNttggggt |
| 812 | IGR3131a_1 | t/g | | Verified | genomic | 1308 | | tgtgtgtgNgggtctga |
| 813 | IGR3133a_1 | a/g | | Verified | genomic | 2029 | | tcgggcaNgcatgca |
| 814 | IGR3133a_2 | t/g | | Verified | genomic | 2301 | | ttttagtNtgagtccc |
| 815 | IGR3134a_1 | a/g | | Verified | genomic | 2594 | | gcctcaNtggatttt |
| 816 | IGR3138a_1 | a/g | | Verified | genomic | 508 | | agctcctNccctcag |
| 817 | IGR3141a_1 | t/c | | Verified | genomic | 125 | | gggaagcNggtctggg |
| 818 | IGR3145a_1 | a/c | | Verified | genomic | 373 | | gaaaggaNtgaaatgc |
| 819 | IGR3145a_2 | a/g | | Verified | genomic | 420 | | gcctgcaNcacttgc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 820 | IGR3145a_3 | ins/w+ | polymorphic CAAA | Verified | genomic | 379 | | aaaggactgaaaNgccccagaggc |
| 821 | IGR3148a_1 | t/c | | Verified | genomic | 1733 | | ttcacaccNggaagct |
| 822 | IGR3149a_1 | a/g | | Verified | genomic | 2119 | | aggaaacNttcttct |
| 823 | IGR3150a_1 | a/g | | Verified | genomic | 262 | | ccagagaNgtacagaa |
| 824 | IGR3152a_1 | t/c | | Verified | genomic | 1223 | | gccgggcNgatagcct |
| 825 | IGR3153a_1 | other/w+ | CA repeat | Verified | genomic | 1817 | | ttgcgtaNacacaca |
| 826 | IGR3153a_2 | g/c | | Verified | genomic | 2055 | | gaactggaNagaagtctc |
| 827 | IGR3158a_1 | a/c | | Verified | genomic | 669 | | gggagacNcctttac |
| 828 | IGR3159a_1 | ins/w+ | | Verified | genomic | 1004 | | gtgtgtgNgggggg |
| 829 | IGR3161a_1 | g/c | | Verified | genomic | 2042 | | gctgagaNcctatcat |
| 830 | IGR3162a_1 | a/g | | Verified | genomic | 2539 | | gccttctNtatgcag |
| 831 | IGR3162a_2 | a/g | | Verified | genomic | 2686 | | tgggacaNgaacaac |
| 832 | IGR3162a_3 | a/g | | Verified | genomic | 2816 | | ccttcccNtgaggcc |
| 833 | IGR3162a_4 | g/c | | Verified | genomic | 2959 | | cagccccNtctcccc |
| 834 | IGR3163a_1 | t/c | | Verified | genomic | 478 | | gacagtaNagcctgtga |
| 835 | IGR3166a_1 | a/g | | Verified | genomic | 325 | | gctgctatNaggtgcagg |
| 836 | IGR3166a_2 | other/ poly t | | Verified | genomic | 651 | | ccatccttcNttttttt |
| 837 | IGR3169a_1 | a/g | | Verified | genomic | 40 | | tgtcgccNagtccagt |
| 838 | IGR3169a_2 | t/c | t in ref | Not yet verified | genomic | 505 | | aacggagtNtgtgcctct |
| 839 | IGR3170a_1 | t/g | | Verified | genomic | 73 | | gtggaNagttaaa |
| 840 | IGR3170a_2 | t/c | | Verified | genomic | 191 | | cagtcccNgagaagt |
| 841 | IGR3171a_1 | t/c | | Verified | genomic | 213 | | ttctattaaNgggagaatcc |
| 842 | IGR3173a_1 | a/g | | Verified | genomic | 126 | | taaatcccaNatggattc |
| 843 | IGR3174a_1 | a/c | | Verified | genomic | 489 | | aataaataNtcattatt |
| 844 | IGR3176a_1 | other/ poly t w+ | | Verified | genomic | 107 | | cccccaccNttttttt |
| 845 | IGR3178a_1 | a/g | | Verified | genomic | 310 | | ggatcatNtttaaagag |
| 846 | IGR3178a_2 | del/w+ | | Verified | genomic | 279 | | ggaattgtNaatactt |
| 847 | IGR3179a_1 | t/c | C in ref | Not yet verified | genomic | 554 | | tcctggcNtcaaggga |
| 848 | IGR3181a_1 | a/g | G in ref | Not yet verified | genomic | 257 | | ggggaccaNgcagaaa |
| 849 | IGR3182a_1 | a/c | C in ref | Not yet verified | genomic | 614 | | acaaaacNcaaacaa |
| 850 | IGR3182a_2 | a/t | | Verified | genomic | 620 | | aacacaaacNaaaaaacagggccaa |
| 851 | IGR3183a_1 | t/g | | Verified | genomic | 131 | | aaacaggNccaaatgacta |
| 852 | IGR3183a_2 | other/ poly A w+ | | Verified | genomic | 248 | | agggaaagNaaaaaaa |
| 853 | IGR3185a_1 | a/t | | Verified | genomic | 211 | | aaacaatcNctacagtt |
| 854 | IGR3185a_2 | g/c | G in ref | Not yet verified | genomic | 558 | | aaaacatNatacagga |
| 855 | IGR3185a_3 | a/g | G in ref | Not yet verified | genomic | 529 | | aaaagtNaagtccta |
| 856 | IGR3186a_1 | other/ poly t w+ | | Verified | genomic | 174 | | gttggcaaNttttttt |
| 857 | IGR3186a_2 | g/c | | Not yet verified | genomic | 58 | | aaaacatNatacagg |
| 858 | IGR3188a_1 | a/g | | Verified | genomic | 152 | | gcactaNccaaaatat |
| 859 | IGR3188a_2 | a/g | A in ref | Not yet verified | genomic | 508 | | aacaataNcaaatgtt |
| 860 | IGR3189a_1 | a/g | G in ref | Not yet verified | genomic | 139 | | acctaggNatttcactcc |
| 861 | IGR3189a_2 | t/c | | Verified | genomic | 394 | | gaaagaaNatatattgt |
| 862 | IGR3189a_3 | a/g | A in ref | Not yet verified | genomic | 429 | | gttcaaNatctgac |
| 863 | IGR3191a_1 | a/g | | Verified | genomic | 215 | | cccctgcNacctcactt |
| 864 | IGR3191a_2 | t/c | | Verified | genomic | 246 | | cacttagNcttttatc |
| 865 | IGR3192a_1 | t/c | | Verified | genomic | 328 | | ggggagaNccacacct |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 866 | IGR3193a_1 | a/g | | Verified | genomic | 409 | | gagacaNgagagga |
| 867 | IGR3194a_1 | t/c | C in ref | Not yet verified | genomic | 296 | | aaaggatNtggggtctt |
| 868 | IGR3196a_1 | t/c | | Verified | genomic | 137 | | cacacgctNgcgtatgca |
| 869 | IGR3196a_2 | other/ w+ | tg repeat | Verified | genomic | 177 | | gcatataaaNtgtgtgtgt |
| 870 | IGR3197a_1 | other/ w+ | poly t | Verified | genomic | 308 | | tgtggtgaNttttttt |
| 871 | IGR3199a_1 | other/ w+ | poly a | Verified | genomic | 131 | | tgagtctcNaaaaaaa |
| 872 | IGR3200a_1 | a/g | | Verified | genomic | 342 | | ctccaccNttgttcccc |
| 873 | IGR3201a_1 | a/t | A in ref | Not yet verified | genomic | 234 | | aggactNatctcta |
| 874 | IGR3203a_1 | a/g | | Verified | genomic | 538 | | ctgcttcNaggagcca |
| 875 | IGR3205a_1 | t/g | | Verified | genomic | 1035 | | taatggaNtaaggat |
| 876 | IGR3205a_2 | a/g | | Not yet verified | genomic | 548 | | cacatggttNcaatgtcac |
| 877 | IGR3206a_1 | t/c | | Verified | genomic | 1176 | | aagatctcNagggtggg |
| 878 | IGR3206a_2 | g/c | | Verified | genomic | 1511 | | gacaggNatgttctat |
| 879 | IGR3206a_3 | g/c | | Verified | genomic | 552 | | gagacaggNatgttctat |
| 880 | IGR3207a_1 | t/c | | Verified | genomic | 205 | | aaaaaaccttNggctgtct |
| 881 | IGR3208a_1 | a/t | | Not yet verified | genomic | 206 | | ctgccctggNttacctggg |
| 882 | IGR3210a_1 | other/ w+ | Poly T | Verified | genomic | 59 | | ttttgtgtgtgtggNtttttt |
| 883 | IGR3222a_1 | a/c | | Not yet verified | genomic | 594 | | gccacatNtgtcatca |
| 884 | IGR3230a_1 | t/g | | Verified | genomic | 462 | | agagacacacctgggNagagatgctgg |
| 885 | IGR3230a_2 | a/g | | Not yet verified | genomic | 491 | | cccacttccaaccNtgtctgg |
| 886 | IGR3236a_1 | t/g | | Not yet verified | genomic | 320 | | gagaggNtgatgt |
| 887 | IGR3238a_1 | g/c | G in ref | Not yet verified | genomic | 280 | | gggccagNgcaagtt |
| 888 | IGR3242a_1 | a/g | | Not yet verified | genomic | 319 | | aacctaNggggaggg |
| 889 | IGR3244a_1 | ins/ w+ | | Not yet verified | genomic | 91 | | tcccgcNtgtgtct |
| 890 | IGR3248a_1 | t/c | | Not yet verified | genomic | 395 | | actgtcNccaactt |
| 891 | IGR3252a_1 | other/ w+ | poly T | Not yet verified | genomic | 183 | | tctaccNttttttt |
| 892 | IGR3252a_2 | t/g | | Verified | genomic | 136 | | gtgctgtNggactgaa |
| 893 | IGR3266a_1 | a/g | | Not yet verified | genomic | 156 | | caggtggNatgttcttg |
| 894 | IGR3266a_2 | a/g | | Verified | genomic | 185 | | ccactgggNccctggctt |
| 895 | IGR3268a_1 | t/c | | Not yet verified | genomic | 367 | | tgtttgtaNtcttctcc |
| 896 | IGR3268a_2 | t/c | | Not yet verified | genomic | 385 | | aggaactgNctcgacat |
| 897 | IGR3274a_1 | a/g | | Verified | genomic | 126 | | cttctaggaNcatttcag |
| 898 | IGR3274a_2 | a/g | | Verified | genomic | 284 | | tgcagaatNcagtggagc |
| 899 | IGR3276a_1 | other/ w+ | poly t | Verified | genomic | 340 | | cttcttcttcNttttttttttt |
| 900 | IGR3276a_2 | ins/ w+ | ins G | Verified | genomic | 221 | | ttctgtcgctNtgatttgg |
| 901 | IGR3278a_1 | other/ w+ | poly t | Verified | genomic | 69 | | cttctttatcNttttttttt |
| 902 | IGR3292a_1 | other/ w+ | poly t | Verified | genomic | 518 | | ttcatctcNttttttttttt |
| 903 | IGR3294a_1 | t/c | T in ref | Verified | genomic | 366 | | aatttatcctccttttcaaagaaNttgaattttgaatct |
| 904 | IGR3298a_1 | a/g | | Not yet verified | genomic | 76 | | gttccttccgNttttttccac |
| 905 | IGR3300a_2 | g/c | | Verified | genomic | 366 | | cctgagaggcatcaaaNtcaaatatgatcaa |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 906 | IGR3302a_1 | a/g | | Verified | genomic | 218 | | catctcatttgtatcNgtcacctgattggg |
| 907 | IGR3304a_1 | ins/w+ | | Verified | genomic | 319 | | tttgggagggtgaggtgggNggatcaggaggtcaggag |
| 908 | IGR3310a_1 | a/g | | Not yet verified | genomic | 361 | | ggaccaaNctggggtg |
| 909 | IGR3310a_4 | other/w+ | poly a | Not yet verified | genomic | 86 | | aaaaaaaaaaNgtttccc |
| 910 | IGR3312a_1 | ins/w+ | | Verified | genomic | 249 | | cagataagcatcagatttgNaaacttacaatgggaatg |
| 911 | IGR3324a_1 | t/c | | Not yet verified | genomic | 388 | | tattgtattccaattNtggatgtagccacca |
| 912 | IGR3326a_1 | other/w+ | tg repeat | Verified | genomic | 261 | | tattcctagtctgtggagaggNttttgtttgtttgtttg |
| 913 | IGR3326a_3 | t/g | | Verified | genomic | 295 | | tttgttNtttagacagagtctca |
| 914 | IGR3328a_1 | t/c | | Verified | genomic | 586 | | tatatttagttttcatNgtgaattcttcttgacc |
| 915 | IGR3330a_1 | other/w+ | poly t | Verified | genomic | 200 | | tacctcNtttttt |
| 916 | IGR3330a_2 | other/w+ | poly t | Verified | genomic | 512 | | ttttttttNaaccttaaa |
| 917 | IGR3332a_1 | other/w+ | Poly A | Verified | genomic | 347 | | catctcNaaaaaa |
| 918 | IGR3336a_2 | other/w+ | poly a | Verified | genomic | 467 | | aaaaaaaaNgagagag |
| 919 | IGR3340a_1 | a/g | | Not yet verified | genomic | 524 | | agactaNcacagaaa |
| 920 | IGR3348a_1 | t/c | T in reference | Verified | genomic | 91 | | ccacatNctctcc |
| 921 | IGR3348a_2 | a/g | A in reference | Verified | genomic | 202 | | gatggtNagcatt |
| 922 | IGR3348a_3 | a/g | A in reference | Verified | genomic | 216 | | tttcatNtgtttt |
| 923 | IGR3348a_5 | t/c | | Verified | genomic | 129 | | aatgatNgccatt |
| 924 | IGR3348a_6 | a/g | | Verified | genomic | 264 | | gttcatNtccttg |
| 925 | IGR3348a_8 | a/g | A in ref | Verified | genomic | 618 | | gattttNtataagg |
| 926 | IGR3348a_9 | a/g | | Not yet verified | genomic | 584 | | tctaacNtttaag |
| 927 | IGR3350a_1 | g/c | G in Reference | Verified | genomic | 77 | | catgagNatggaa |
| 928 | IGR3350a_10 | a/g | | Not yet verified | genomic | 451 | | cctgcctNattgccc |
| 929 | IGR3350a_11 | t/c | C in reference | Verified | genomic | 450 | | cctgccNaattgccc |
| 930 | IGR3350a_2 | t/c | T in Reference | Verified | genomic | 88 | | gaatgttNttccatt |
| 931 | IGR3350a_3 | g/c | G in reference | Verified | genomic | 236 | | gatttggNtctctg |
| 932 | IGR3350a_4 | t/c | C in reference | Verified | genomic | 247 | | tgtttgNctgtttg |
| 933 | IGR3350a_7 | t/c | C in reference | Verified | genomic | 321 | | agttgcNtatcag |
| 934 | IGR3350a_8 | g/c | C in reference | Verified | genomic | 349 | | ggctgaNacaatg |
| 935 | IGR3352a_1 | a/g | A in reference | Verified | genomic | 282 | | gggatcNgtggtg |
| 936 | IGR3352a_2 | t/c | T in reference | Verified | genomic | 314 | | ttattgNgtctcat |
| 937 | IGR3352a_3 | t/c | T in reference | Verified | genomic | 330 | | attcttNtctctt |
| 938 | IGR3352a_4 | a/g | | Not yet verified | genomic | 177 | | tgggagNgtgtat |
| 939 | IGR3352a_5 | t/c | T on reference | Not yet verified | genomic | 339 | | tcttttNttcttt |
| 940 | IGR3352a_6 | a/g | G in ref | Verified | genomic | 547 | | gtgtcaNttttgga |
| 941 | IGR3370a_1 | other/w+ | poly t | Verified | genomic | 354 | | cttttccNtttttt |
| 942 | IGR3370a_2 | t/c | | Verified | genomic | 378 | | agacagNcttgctc |
| 943 | IGR3374a_1 | a/t | | Verified | genomic | 193 | | ggctatNgaaaaa |
| 944 | IGR3378a_1 | a/t | | Verified | genomic | 418 | | gctggaNcataaag |
| 945 | IGR3378a_2 | a/t | | Verified | genomic | 563 | | cttttNaaaatagg |
| 946 | IGR3388a_1 | a/t | | Not yet verified | genomic | 48 | | aatctttaNagtacatt |
| 947 | IGR3388a_2 | other/w+ | | Not yet verified | genomic | 441 | | gttgaaatcNtttttttttt |
| 948 | IGR3394a_1 | t/c | | Not yet verified | genomic | 493 | | ccctacaNgtaaat |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 949 | IGR3406a_1 | t/c | | Not yet verified | genomic | 158 | | aaatataNacatttat |
| 950 | IGR3420a_1 | a/g | | Not yet verified | genomic | 322 | | cgccttcNataaaa |
| 951 | IGR3428a_2 | a/g | A in ref | Not yet verified | genomic | 278 | | tataaggtNtaagg |
| 952 | IGR3454a_1 | t/c | | Not yet verified | genomic | 382 | | tcccattNtgtaggtt |
| 953 | IGR3454a_2 | t/c | | Not yet verified | genomic | 450 | | aattagaNcccattt |
| 954 | IGR3456a_1 | a/g | G in Reference | Not yet verified | genomic | 42 | | tcttccNtttgtt |
| 955 | IGR3456a_2 | a/t | T in Reference | Not yet verified | genomic | 81 | | gtggttNgtagtt |
| 956 | IGR3456a_3 | t/c | T in reference | Not yet verified | genomic | 108 | | ccttcaNgtccct |
| 957 | IGR3456a_4 | a/g | G in Reference | Not yet verified | genomic | 109 | | cttcatNtcccctt |
| 958 | IGR3456a_5 | t/g | T in reference | Not yet verified | genomic | 178 | | actcatNgtttgg |
| 959 | IGR3456a_6 | a/g | G in Reference | Not yet verified | genomic | 179 | | ctcattNttttggc |
| 960 | IGR3456a_7 | other/ w+ | Poly T | Not yet verified | genomic | 204 | | ctctctcNttttttt |
| 961 | IGR3456a_9 | a/g | | Not yet verified | genomic | 398 | | catgtcNcctgcaaa |
| 962 | IGR3460a_1 | g/c | C in Reference | Not yet verified | genomic | 118 | | tttgtgNgcagag |
| 963 | IGR3462a_1 | other/ w+ | poly t | Not yet verified | genomic | 419 | | ttttttNgctcatca |
| 964 | IGR3466a_1 | a/g | | Not yet verified | genomic | 185 | | gcctcatgNaccctacc |
| 965 | IGR3466a_2 | g/c | | Not yet verified | genomic | 503 | | ctcacaaaNgctccagt |
| 966 | IGR3470a_1 | a/t | | Not yet verified | genomic | 199 | | gctggaggNaggactag |
| 967 | IGR3470a_2 | t/c | | Not yet verified | genomic | 438 | | gtcaaattNattcattt |
| 968 | IGR3470a_3 | a/t | | Not yet verified | genomic | 178 | | tccagctgaNgatgcagg |
| 969 | IGR3470a_4 | a/t | | Not yet verified | genomic | 214 | | agccctgaNtgggcacca |
| 970 | IGR3475a_1 | a/c | | Verified | genomic | 483 | | caccctgctNtatacact |
| 971 | IGR3475a_2 | t/c | | Verified | genomic | 490 | | ctatacaNtggttggt |
| 972 | IGR3477a_1 | t/g | | Verified | genomic | 468 | | ccaggtcaagNtgctgagtg |
| 973 | IGR3479a_1 | a/g | | Verified | genomic | 178 | | tagtggtgNagtctgggc |
| 974 | IGR3479a_2 | a/t | | Not yet verified | genomic | 229 | | cgtacccaNtaggtaat |
| 975 | IGR3481a_1 | a/t | | Not yet verified | genomic | 139 | | ctgggaggaNctggggact |
| 976 | IGR3483a_1 | a/g | | Verified | genomic | 539 | | gtgatgggNtgccttaaag |
| 977 | IGR3483a_2 | t/g | | Verified | genomic | 495 | | atctggtaaNaggtgtgg |
| 978 | IGR3483a_3 | a/c | | Not yet verified | genomic | 135 | | gaaacaggNgcggtggca |
| 979 | IGR3485a_1 | a/g | | Verified | genomic | 198 | | ctctgaaggNtcatcacag |
| 980 | IGR3487a_1 | a/t | | Not yet verified | genomic | 184 | | ctctccaagcNcctgctagta |
| 981 | IGR3493a_1 | a/c | | Not yet verified | genomic | 434 | | ctctttattaNtcccttttccca |
| 982 | IGR3493a_2 | t/c | | Verified | genomic | 517 | | gatgaaggaNtgggtcatgc |
| 983 | IGR3493a_3 | a/g | | Not yet verified | genomic | 534 | | tgctaccaNgtgagcca |
| 984 | IGR3493a_4 | g/c | | Not yet verified | genomic | 542 | | aggtgagccaNcaggatgag |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| 985 | IGR3495a_1 | a/g | | Not yet verified | genomic | 195 | | tcacaacaNaagtctcag |
| 986 | IGR3499a_1 | t/c | | Verified | genomic | 467 | | aggggtggactgtNatctgttcct |
| 987 | IGR3501a_1 | other/ poly T w+ | | Not yet verified | genomic | 503 | | ttcatgaaagacNttttttttttttg |
| 988 | IGR3505a_1 | t/c | | Verified | genomic | 213 | | tgccctctcNgggccttgggg |
| 989 | IGR3515a_1 | a/g | | Verified | genomic | 604 | | agtgtggggatgNaacctccagc |
| 990 | IGR3515a_2 | t/g | | Not yet verified | genomic | 440 | | ctccttccgNccaggttga |
| 991 | IGR3519a_1 | t/c | | Verified | genomic | 230 | | tttcctccctNccctgcctca |
| 992 | IGR3523a_1 | t/c | T in ref | Verified | genomic | 193 | | cacggccagNagcctcttg |
| 993 | IGR3525a_1 | t/g | | Verified | genomic | 322 | | ttcagagggggtgNggctgggtcaagt |
| 994 | IGR3527a_1 | t/c | | Verified | genomic | 87 | | cactgtggNctgagtctg |
| 995 | IGR3529a_1 | a/g | | Verified | genomic | 251 | | catgtacaggNgacagatctgg |
| 996 | IGR3529a_2 | t/c | | Verified | genomic | 120 | | aagtgtgctNtgaatgtga |
| 997 | IGR3531a_1 | t/c | | Not yet verified | genomic | 361 | | tcaaccctgNatctgtacaa |
| 998 | IGR3533a_1 | a/g | | Verified | genomic | 137 | | cacagggagNgtttgaga |
| 999 | IGR3535a_1 | g/c | | Not yet verified | genomic | 462 | | cttgtcctNgtggggagga |
| ### | IGR3535a_2 | a/t | | Not yet verified | genomic | 363 | | tcgagcctgNctgatggcaaa |
| ### | IGR3537a_1 | a/g | | Verified | genomic | 426 | | ggaggttgtagNgcagaagtt |
| ### | IGR3551a_1 | a/c | | Not yet verified | genomic | 403 | | ggccatccaNcagaaac |
| ### | IGR3553a_2 | a/g | | Verified | genomic | 125 | | tcccccacNctgatcac |
| ### | IGR3553a_3 | t/c | | Verified | genomic | 426 | | gaattgtgcctaNggagtacgc |
| ### | IGR3555a_1 | t/c | | Verified | genomic | 188 | | actgcagcctNgacctccca |
| ### | IGR3563a_1 | a/g | | Verified | genomic | 655 | | ttcgggtcaNagtacct |
| ### | IGR100a_1 | a/g | | Not yet verified | genomic | 142 | | acccgtNataattc |
| ### | IGRX320a_1 | t/c | | Not yet verified | genomic | 383 | | tctaaactNgggggaaa |
| ### | IGRX320a_2 | other/ poly t w+ | | Not yet verified | genomic | 393 | | ggggaaacNtttttt |
| ### | IGRX460a_1 | other/ poly t w+ | | Not yet verified | genomic | 292 | | ttttttttNgagatgga |
| ### | IGRX610a_1 | t/c | | Not yet verified | genomic | 684 | | attccttgNgttggcct |
| ### | IGRX610a_2 | a/g | | Not yet verified | genomic | 827 | | tttgctcNgctgcct |
| ### | IGRX650a_1 | a/g | | Not yet verified | genomic | 344 | | atcaggtNatgttta |
| ### | IGRX660a_1 | a/g | | Not yet verified | genomic | 203 | | tctagtgaNgacacccag |
| ### | IGRX665a_1 | other/ poly A w+ | | Not yet verified | genomic | 309 | | acagatcttNaaaaaa |
| ### | IL13_5240 | a/g | | Verified | gene | n/a | Interleukin 13 | aaactttttcgcgagggacNgttcaactgaaacttc gaaagcatcat |
| ### | IL13_5710 | a/g | | Verified | gene | n/a | Interleukin 13 | ttggggaagactgtggctgctNgcacttggagcca agggttcagac |
| ### | IL13_5570 | a/c | | Verified | gene | n/a | Interleukin 13 | agcactaaagcagtggaNcccaggagtccctggt aataagt |
| ### | IL13_5940 | c/t | | Verified | gene | n/a | Interleukin 13 | cgagtaatttattgttttttcctNgtatttaaatattaaata tgtt |
| ### | IL3_4400 | c/t | | Verified | gene | n/a | Interleukin 3 | ccaagctcccatgacccagacaacgNccttgaag acaagctgggttaactgctctaacatga |
| ### | IL4ex1_2495 | c/t | | Verified | gene | n/a | Interleukin 4 | tcgttagcttctcctgataaactaattgNctcacattgt cactgcaaatcgacacct |
| ### | IL4pro_1940 | c/t | | Verified | gene | n/a | Interleukin 4 | acacctaaacttggagaacattgtNccccagtgc tggggtaggaga |
| ### | IL5pro3 | c/t | | Verified | gene | n/a | Interleukin 5 | tgctcatgaacagaatacataNagtccaggagt ctggacatcatc |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| ### | IL9_4616 | a/g | | Verified | gene | n/a | Interleukin 9 | tgtgaatggtgatgccaaccctgtttgaacNcaaa aggatgataaagttggaattggta |
| ### | IL9_4616 | a/g | | Verified | gene | n/a | Interleukin 9 | gtgaatggtgatgccaaccctgtttgaacNcaaaa ggatgataaagttggaattgg |
| ### | IL9_6085 | c/t | | Verified | gene | n/a | Interleukin 9 | ttcctgtgaacagccatgcaaccaaaccaNggca ggcaacgcgctgacat |
| ### | IL9_6085 | c/t | | Verified | gene | n/a | Interleukin 9 | cctgtgaacagccatgcaaccaaaccaNggcag gcaacgcgctgacat |
| ### | IRF1ex1_1 | g/c | | Verified | gene | n/a | Interferon regulatory factor 1 | aagacgtgcgcccgagccccgccgaaNcgagg ccacccggagccgtgccagt |
| ### | IRF1pro1_2 | c/t | | Verified | gene | n/a | Interferon regulatory factor 1 | cacggggcagggtaggctttctgcctNcttcacttc cccagggcaggtgagt |
| ### | IRFex6_1 | t/c | | Verified | gene | n/a | Interferon regulatory factor 1 | ctgacctgtggggtcncctgccagacct |
| ### | IRFex9_1 | t/g | | Verified | gene | n/a | Interferon regulatory factor 1 | gccactccgactnctccaagagctg |
| ### | IRFex9_2 | t/g | | Verified | gene | n/a | Interferon regulatory factor 1 | tcccatccacgtttnttggctgccactc |
| ### | IRFpro1_1 | a/g | | Verified | gene | n/a | Interferon regulatory factor 1 | gtagggctatattattttatggtt |
| ### | IRFpro1_2 | t/c | | Verified | gene | n/a | Interferon regulatory factor 1 | ggggcagggtaggctttctgcctNcttcacttcccc agggcaggtgagt |
| ### | OCTex5_1 | a/g | | Verified | gene | n/a | carnitine transporter (organic cation transporter) 1 | gaatcaaatatcactgctggtacagctNtgttgttca tttttgcagcttttgga |
| ### | OCTN1ex1_1 | g/c | | Verified | gene | n/a | carnitine transporter (organic cation transporter) 1 | gctgttagaaattggggcgcgaaNccggggacc gttcctgggaaaca |
| ### | OCTN1ex3_1 | t/c | | Verified | gene | n/a | carnitine transporter (organic cation transporter) 1 | gccctgagtcaggcatcaatgcagaNttagtgttttt tcagggctctggcag |
| ### | OCTN1ex6_1 | t/c | | Verified | gene | n/a | carnitine transporter (organic cation transporter) 1 | ggatatctgcatttccaggtcacttattaNttaccata gcagcaaagacataatgg |
| ### | OCTN1ex6_2 | t/c | | Verified | gene | n/a | carnitine transporter (organic cation transporter) 1 | cttatgcatgcaactctcacttcaccttgac |
| ### | OCTN1ex9_1 | a/g | | Verified | gene | n/a | carnitine transporter (organic cation transporter) 1 | ctcagtcatgtgtgacagatgttcctttgNtagagttc tttgcctaccagagttctc |
| ### | OCTN2ex1_1 | a/g | | Verified | gene | n/a | carnitine transporter (organic cation 1transporter) 2 | gtcgcgccccggctccagcccNagcgccgagaa gttggcgatgg |
| ### | OCTN2ex3_1 | t/c | | Verified | gene | n/a | carnitine transporter (organic cation transporter) 2 | accctgtcccccttgagggacatcacagNtgtctcc agaaaggtaggtgatg |

TABLE 3-continued

Legend:
- EST: expressed sequence tag
- gene: known gene
- Predicted gene: gene predicted from genomic sequence using the GENSCAN package
- ins/del: insertion/deletion
- genomic: derived from resequencing of entire genomic region (therefore includes genes, promoters, enhancers, etc.)

Notes:
1) "N" in sequence represents polymorphic base
2) details are provided where currently available
3) This list includes all polymohisms: SNPs, repeats, and insertions/deletions

| | Polymorphism Name | Poly type | comment #1 Polymorphism details | comment #2 Verification Status | comment #3 | comment #4 Position on reference genomic sequence (attached) | Gene Name | Flanking Sequence |
|---|---|---|---|---|---|---|---|---|
| ### | OCTN2ex3_2 | a/c | | Verified | gene | n/a | carnitine transporter (organic cation transporter) 2 | tctcggtctcacagtgcccatgcta |
| ### | OCTN2ex4_1 | a/g | | Verified | gene | n/a | carnitine transporter (organic cation transporter) 2 | gccagtgggcacatggggcacaNggtcacactc accaccaga |
| ### | OCTN2ex4_2 | t/c | | Verified | gene | n/a | carnitine transporter (organic cation transporter) 2 | actcaccaccagagtgccacgcaNagcaccccc ggcatcgtcagcgcc |
| ### | OCTN2ex6_1 | t/c | | Verified | gene | n/a | carnitine transporter (organic cation transporter) 2 | aacttccctaggccttgtcagtaaNaaatcagagtg aatgaaaatgagga |
| ### | OCTN2ex6_2 | t/c | | Verified | gene | n/a | carnitine transporter (organic cation transporter) 2 | tatcctttcactctctgatgacaNaggctttgaattttg tctgaggc |
| ### | OCTN2ex7_1 | g/c | | Verified | gene | n/a | carnitine transporter (organic cation transporter) 2 | gcaagttaggagtatcaagcgaaaNccaaaata gcccactgatatggtc |
| ### | Polyex3_1 | t/g | | Verified | gene | n/a | Prolyl 4 hydroxylase | gcctataagaggaaacctttgagaggNtgatgtgg ggctggcctggttacttcatg |
| ### | Polyex6_1 | t/c | | Verified | gene | n/a | Prolyl 4 hydroxylase | ctatccagtggctcaggctttccttgaagNgggaat ctcttcctaatcca |
| ### | Rad50ex16_1 | ins/del | ins/del caa | Verified | gene | n/a | RAD50 | tctctctgtaNaaagactgaa |
| ### | Rad50ex16_2 | other/w+ | ta repeat | Verified | gene | n/a | RAD50 | agactgtctcNaaaaataaa |
| ### | Rad50ex16_3 | ins/del | ins/del t | Verified | gene | n/a | RAD50 | ttaaaataatttNacaaaaaacat |
| ### | Rad50ex25a_1 | other/w+ | ca repeat | Verified | gene | n/a | RAD50 | atttaggaNccccccc |
| ### | Rad50ex4_1 | t/c | | Verified | gene | n/a | RAD50 | cctttctgcttttaaaNttttctgttaaaaag |
| ### | Rad50ex4_2 | t/c | | Verified | gene | n/a | RAD50 | ttaatggactacaaagtNtatttaagggttacaa |
| ### | Rad50ex7_1 | a/t | | Verified | gene | n/a | RAD50 | gagattcttcattcaNacagaaaatgtataacat |
| ### | Sept2ex10b_1 | a/g | | Verified | gene | n/a | Septin-like | ttctaaatatttattttgNcaccagcgtcaagacaa |
| ### | Sept2ex10c_1 | a/g | | Verified | gene | n/a | Septin-like | attaagactcccaagcNaatcctgcatattccaa |
| ### | Sept2ex10d_1 | t/c | | Verified | gene | n/a | Septin-like | gtgtgtgtccacNgaggcacgg |
| ### | Sept2ex10f_1 | a/g | | Verified | gene | n/a | Septin-like | tccctgttaagtNgggctcatgga |
| ### | Sept2ex2_1 | g/c | | Not yet verified | gene | n/a | Septin-like | tgtcagggcctgNcctcagaca |
| ### | Sept2ex3_1 | t/c | | Verified | gene | n/a | Septin-like | ccccagacctaNgacctccagga |
| ### | TCF_1625 | c/t | | Verified | gene | n/a | t cell transcription factor 1 | cactttgcctgcaggtgcaccgaaaggaCNtggg ggataaaattcaaaaaagtgtgat |

TABLE 4

Summary of best SNPs in chromosome 5 region.

| SNP marker name | Approximate Physical position[1] | SNP type | Transmitted allele | Frequency of allele[2] | Transmitted | Untransmitted | $C^2$ | p-value |
|---|---|---|---|---|---|---|---|---|
| IGR2055a_1 | 435.0 | G/T | G | 0.357 | 87 | 39 | 18.29 | 0.000019 |

TABLE 4-continued

Summary of best SNPs in chromosome 5 region.

| SNP marker name | Approximate Physical position[1] | SNP type | Transmitted allele | Frequency of allele[2] | Transmitted | Untransmitted | $C^2$ | p-value |
|---|---|---|---|---|---|---|---|---|
| IGR2060 a_1 | 437.5 | C/G | C | 0.351 | 81 | 34 | 19.21 | 0.000012 |
| IGR2063 b_1 | 439.0 | C/G | G | 0.359 | 87 | 37 | 20.16 | 0.000007 |
| IGR2069 a_2 | 442.0 | C/T | T | 0.627 | 52 | 20 | 14.22 | 0.00016 |
| IGR2078 a_1 | 446.5 | A/G | A | 0.364 | 48 | 16 | 16.00 | 0.000063 |
| IGR2096 a_1 | 455.5 | A/C | A | 0.349 | 75 | 32 | 17.28 | 0.000032 |
| IGR2198 a_1 | 506.5 | C/G | G | 0.364 | 87 | 41 | 16.53 | 0.000048 |
| IGR2230 a_1 | 522.5 | C/T | T | 0.415 | 67 | 28 | 16.01 | 0.000063 |
| IGR2277 a_1 | 546.0 | A/G | G | 0.417 | 79 | 37 | 15.21 | 0.000096 |
| IGR3081 a_1 | 609.0 | G/T | G | 0.338 | 79 | 35 | 16.98 | 0.000038 |
| IGR3096 a_1 | 616.5 | C/T | C | 0.429 | 89 | 42 | 16.86 | 0.00004 |
| PROLYL ex3 1 | 686.5 | G/T | T | 0.383 | 79 | 39 | 13.56 | 0.00023 |

[1]Position (kb) on the 850 kb reference sequence.
[2]Frequency of allele calculated from the untransmitted parental chromosomes.

TABLE 5

```
>IGR2001a
ggcccgaaaggactgtgcccctcccgtcaaacaccccccccgcgtcccccaccaag
ttctggccggggctgtggagcgtgggtcacctgggggcgaaggactccacatcacggtga
agtggaggtgctgcagcccccacaaagcccgagaagcctgccaggggcgccccgggcgaa
cggcagtgggcgtgggccgttctgcagcacccattggcgcggggggaggagagtgctgatc
ccatcaagccccgctccaggtcgcggccgctgggcctggcccaggagcctcccccggcct
cggggccccatgggactgacaggggggctgagttctcttttcctcccaacggcggtgtttat
aagaaatgaagctccgcagcggccatcagcggcagcccacactgtcaccccgccccgctc
tcagggggttccggaacagccctgagcactggagcaattccttggctcagtattctatca
tgaccccctagtgattttccagccagcttcagccccacattctgcatttaggaatttat
aacagtgcaacgtttattctgctgtgtcatacagcatattttgccaaacctttgagaggg
gaggggctggtctggtgccccagtgtatctccagaaccaaacctggggttcaccaaaaag
caggcctgcgtgattcatatgtgttgaatgaattaaggga >IGR2002a
cagccagcttcagccccacattctgcatttaggaattttataacagtgcaacgtttattc
tgctgtgtcatacagcatattttgccaaacctttgagaggggaggggctggtctggtgcc
ccagtgtatctccagaaccaaacctggggttcaccaaaaagcaggcctgcgtgattcata
tgtgttgaatgaattaagggactttctttctctccagttaggctccttgcaggcagggtg
atgaccttggattctgccttcaagcttttggatgcttttatttctggcttgtgttctgc
aattcacagtttaggactgcctgcctcccaggtttctgtgaaaatcgagatgaaggattt
gagcatttcagagagccctactacttctggacctggaacctggaaggcatgctggggagt
ttgtctgctttggggaccgtggcccctctctgggtagcaggctccacaggtagcaggtc
tcccagtcgaaaacctagttcaggtcgggcgccgtggctcatgcctataatcccagcact
ttgggaggccgaggcggtggatcacctgaggtcaggagttggagaacagcctggccaatg
tggtgaaactccatctccaccaaaaatacaaaaattagctgggcatggtggcgggtgcct
gtaatcccagctacttgggaggctgaggcaggagaattgc >IGR2003a
tcaggtcgggcgccgtggctcatgcctataatcccagcactttgggaggccgaggcggtg
gatcacctgaggtcaggagttggagaacagcctggccaatgtggtgaaactccatctcca
ccaaaaatacaaaaattagctgggcatggtggcgggtgcctgtaatcccagctacttggg
aggctgaggcaggagaattgctgaaccctggaggtagaggttgcagtgagccgagatca
cgtcactgcactccagcctgggtgacagagcgagactccgtctcaaaaaaacaaaacaaa
aaaacacctagtttaaacctcactggcacctgcacctcagctctcacaaactctcatttc
tgagcacacactcatctctatcagcagaggatttaaccacaggttgccaagaaatgtctg
tatctgagagaattcataatctgagatagaaggaacactaaactccagaggaagaggggt
cacacatcaacttaactaggatttactgagtgcctaccatggtagccactcttcggggga
gtgcaaggatggcggcatcaccttagtgtggtccgtgtggccctgtgcattgatgtgtgt
gtgcatggtgacatgtgggagccatgcttctgggcttcaggactaactgcagcccactt
agggggtgaacagtgttttgagagcctgagggaggggact
```

TABLE 5-continued

>IGR2004a
gatttactgagtgcctaccatggtagccactcttcgggggagtgcaaggatggcggcatc
acctagtgtgtgtccgtgtggccctgtgcattgatgtgtgtgtgcatggtgacatgttgg
gagccatgcttctgggcttcaggactaactgcagcccacttaggggtgaacagtgttttt
gagagcctgagggagggactgggacaagaattgtctgtcaggtgtagaggctcccacag
ggtgtgtgaatgtgtgtgtgagatgatcttgccttcagcatcctgattgcagaagtcact
tcaaaggagccctgccagccagttagcctcctcttgccagcacagaaaaatccaggtcc
caatacagagaggccacacaatgaattcaccctcattgagtgaggctatggatgagaggc
atctgtaaggaagaccttgcacagtgcagggtgctggctaccctcagctaacccctagct
cgcttcagctgctgggcatgaggaacctgcttagatttctcacagaaaacatggagagtt
cttttttctcacagaaaaatgtagagtttgttccccagagtttgttcccaccatgtagaa
agtgaccagtggtgaaaagaaacataggaaagttaaggaccaaagggtccaaggaggga
aaagaaaggacttctggttggttgctttgcgggcattttg >IGR2005a
gaggaacctgcttagatttctcacagaaaacatggagagttcttttttctcacagaaaaaa
tgtagagtttgttccccagagtttgttcccaccatgtagaaagtgaccagtggtgaaaag
gaaacataggaaagttaaggaccaaagggtccaaggagggaaaagaaaggacttctggtt
ggttgctttgcgggcattttgaagagatcaggcatatgctctgggccttaaaaaaagaca
cagagattgaagtggtggggtgggcaagggagagagagatggagagagggtgagtgttgc
caagtatcctgaggagacagggatgaggggacaaacacattgtgttcagataatggaaat
acagtgaaaggttcatgcgttcctgttcatacatttcatttgacttatgtcttacagttt
ggaaataattttgatagtctaattttacaattaggagagatggagagagattatctctat
tttacagatgagaaactgagccccagagagggacagtaacttgctaagatcacatagca
agtggaaaaagcacaataagaacccaggctttcagactcaaatcctgtgttctcttttca
tcccccttagtttcatctttcctactgccaagggtagggaagctgtcagggacagaagg
ttggaatgggaccccaggacaagactgagcagagatttga >IGR2006a
agccccagagagggacagtaacttgctaagatcacatagcaagtggaaaaagcacaataa
gaacccaggctttcagactcaaatcctgtgttctcttttcatcccccttagtttcatct
ttcctactgccaagggtagggaagctgtcagggacagaaggttggaatgggaccccagga
caagactgagcagagatttgaatgtggggctgaatgtaggggagctcagaaggctcctgg
gtggccccgagtgttaggagatcatccgagttagggagatcattccagtgcagaggcac
catcttcccatctacctgggcaaggcaaggaggcccaaggggaggttggggcaacaata
gtctggtcctggactatgaaatcacaacccgatacagggaaggaagacccagaagaccag
gtgggaaagaaaagggctggctccgaattaataagagcctacaggagcctatgtgttctg
ctggggatcacagaatgttctacatcttagaatgtgattcatcaaaagccattacaataa
aaatgttgggtacttaaacatggcttagctttatttcactgatttggagtatagcaccc
tagtcataataagcatattcttacaggcttcaaaataaagtaagaatccctaaggttaaa
aaaaaaaaaaggtcaaagatgtaaatgtaaatgacagtt >IGR2007a
ctacatcttagaatgtgattcatcaaaagccattacaataaaaatgttgggtacttaaac
atggcttagctttatttcactgatttggagtatagcacccctagtcataataagcatatt
cttacaggcttcaaaataaagtaagaatccctaaggttaaaaaaaaaaaaaaaaggtcaaag
atgtaaatgtaaatgacagtttcattggtaaatcctaactggggaatttctcctaagcaa
aaaattattgatatgcacaaagatttagctaatagtgttgtttgtattacgaaaaaatgg
aaataacctaactgtcctacaataggggattaatttgggtaaattttttatttatccttgtg
aaagaataatgtatacctattacaaatgacattgcataagtacatttcatgcatgtggaaa
gatgctcattatggctaaatatacatatgcatatacgggtatatttatacctgtatctgt
gaattaaaattaagttttttgttttaaagcatttttttatagtgtcctgttgccttcacagg
gtcactgtggtcaacttatcagaccacaaagatgcaaacttcctttccctaatctcatcc
tgaattttccagtggatgtgtcaggttctcagggaaggacaagcatctatttgctgtac
caagaaaggatcccacgactcaggggtcacttgttttctc >IGR2008a
gttttaaagcatttttttatagtgtcctgttgccttcacagggtcactgtggtcaacttat
cagaccacaaagatgcaaacttcctttccctaatctcatcctgaattttccagtggatgt
gtcaggttctcagggaaggacaagcatctatttgctgtaccaagaaaggatcccacgac
tcaggggtcacttgttttctcttattcttgctcagaaggtcttggtccctgtagcaagtc
cccacttccatttgtcacttaaagtaccccaaaaccccacctttccattccagagtgtcat
tgccctccactttgcttaacactcagttaggttccttcctcagtttctcctacctcctttt
cctctcctagctcctgacccacctctatctggtagacagttttgcccattcctgctggta
tcctgggaaccaggtttggcattggtcacagcactcagattgcaatgcgccagaatggga
ttaacccatgcatttcctctacgggagggaggtagagtgactggcaagtcgaatgttgca
tgggtgtgtctatttatagcctgcaaaatggggtgctgccctgagggagagctgcggtgaaggaaatgacacgcctgg
aaggaaatgacacgcctgggagagtaacttacttctgcaggagctctagggagatgaagg
aagaagcctcctgggccagagttttggatggaaaatgaac >IGR2009a
tacgggagggaggtagagtgactggcaagtcgaatgttgcatgggtgtgtctatttatag
cctgcaaaatggggtgctgccctgagggagagctgcggtgaaggaaatgacacgcctgg
gagagtaacttacttctgcaggagctctagggagatgaaggaagaagcctcctgggccag
agttttggatggaaaatgaacacccagtcaagtctctaggactatacgtggggcggggac
tagttgtgcgcgagagttaagtaggggcccttaccaaggagcatgggacctgggctcccc
aacccttggctagcccatgcgcgttgatcagccctgagctaattcctccatgctgccca
gaacctctctgggccaagccctggggactcagagatgacagcaatgcttccattgcggaa
ctcccatacgcgggccacaggaggctctggaggcggcctgaggcaagagtgctaggagg TABLE 5-continued gatcagagctagcccaccccstaccctcactcagccgtctgggcttctctgaacccecttct
cctcctctgttccctaaagccagccaggggggagtcccagggaggcagaccgaaaagggggt
ggggtgtcatcctggtcactattagaccctgcaacggcgaccttgaaaactactcagcgt
ctgttgcccgagtggagcatagtgctttacaatctcttcc >IGR2010a
ctaccctcactcagccgtctgggcttctctgaaccccttctcctcctctgttccctaaag
ccagccaggggggagtcccagggaggcagaccgaaaagggggtggggtgtcatcctggtcac
tattagaccctgcaacggcgaccttgaaaactactcagcgtctgttgcccgagtggagca
tagtgctttacaatctcttcccatcacagcaaaccatcaaggtagggctactgttatttt
atggttgaaaaacagaggtcctgcgtcccttgggggctgtgccagcagcggccaagttgg
gatttcccctggtccagcagcccagacagcacacggggcagggtaggctttctgcctcc
ttcacttccccagggcaggtgagtgacctggagggagggggtcacccctaaaaacagggg
tagtgctaggactgaaaccctcccttcttgatatcccactggcaagcttgaggagccagg
ctgccagtcgggagattcggcccagtgttcccactggagagggcggcaagtgcccgggcg
atcacctcgcctgcgttcgggagatatacctccgccccgccccgccaggagggtgaaaa
gatggcccccaggagccagccggctgggacaaggcggagtgagaggacaggctggggccgg
gggcgctgggctgtcccgggcagccctcctccgggcaagc >IGR2011a
gcccagtgttcccactggagagggcggcaagtgcccgggcgatcacctcgcctgcgttcg
ggagatatacctccgccccgccccgccaggagggtgaaaagatggcccccaggagccagc
cggctgggacaaggcggagtgagaggacaggctggggccgggggcgctgggctgtcccgg
gcagccctcctccgggcaagccggagcaggggtggattgggagcgctcggggcgggcccg
cggtggcccggggcggtggcgccggccggagagggtgggggagcagccgccctgta
cttcccccttcgccgctagctctacaacagcctgatttccccgaaatgacggcacgcagcc
ggccaatgggcgcccgcgcggctgtccgggggcggggccggccaggggctggggaatcccg
ctaagtgtttggattgctcggtggcgccgctgccctggcagagctcgccactccttagtc
gaggcaagacgtgcgcccgagccccgccgaaccgaggccacccggagccgtgccagtcc
acgccggccgtgcccggcggccttaagaacccggcaacctctgccttcttccctcttcca
ctcggagtcgcgctccgcgcgccctcactgcagccctgcgtcgccgggaccctcgcgcg
cgaccgccgaatcgctcctgcagcagaggtgagtacgcct >IGR2012a
agccccgccgaaccgaggccaccggagccgtgcccagtccacgccggccgtgcccggcg
gccttaagaacccggcaacctctgccttcttccctcttccactcggagtcgcgctccgcg
cgccctcactgcagccctgcgtcgccgggaccctcgcgcgcgaccgccgaatcgctcct
gcagcagaggtgagtacgcctttgaggcgcggggcaccggcggcgtcgaataaaaggcgc
gcggggcaccaggaagtgggggggtcgaaagctccaggctggagactcgccggcgcgcggc
gttgcccgggcctccgcgcgggctccggggggcgccggaggagctgcgagccgcgggccg
cggcgcgggggaggggcgggacgcggcgtggaccgcccacccggacgaggctgccggcgcc
ggcagctttcgcagatctcgtgcgcgcagccgccaggggcctgtaggtggccgctatg
ttcgtcccgcgcatccacacgccgtgccgggaccgagtgtcagcccacgcgtgggcgcc
cagtgctcccggctttcggcggtcccagctccgcgcccaggcgacaggttttgggctccc
tgtgctggtggcaagggctggcttactgcccaggtggctggagggaatcgtgacctacgg
agactgcgggaagaggcgccacaggtgttccttgggccac >IGR2013a
cgccgtgccggggaccgagtgtcagcccacgcgtgggcgcccagtgctcccggctttcgg
cggtcccagctccgcgcccaggcgacaggttttgggctccctgtgctggtggcaagggct
ggcttactgcccaggtggctggagggaatcgtgacctacggagactgcgggaagaggcgc
cacaggtgttccttgggccacttctccagaggagggggaaaccgggccggaagggttagcg
tcctggtcttagcgttgtgggcgctgtggctgtcaggaaggcgtagaatggattcagggg
ggcgggagggggctgttcagggtgacggctagccctttgctagctagtggttacaactca
agtcaagggaatttcttcttggcatcaagcaaaagaagtccctccccttcccaaaggattt
gaattttgagcgaaaagttctgaaattagggtatctgtgcatttttgtctcttttcctgca
tatgaatcctgaagccatcacttgcatgcctgtctcctcagagactggctgggaggggc
tgaaggaagggggcaaaagcatttttgcctaagatgctgaaaaaatttggagagcagtttt
attccagcgcagctcccctccgcactgagtgtagtacctagcagctggctgaggtgaggg
gagggtaactaagtgacctcgggtggggcaggtcactgcc >IGR2014a
acttgcatgcctgtctcctccagagactggctgggaggggctgaaggaaggggcaaaagc
atttttgcctaagatgctgaaaaaatttggagagcagttttattccagcgcagctcccct
ccgcactgagtgtagtacctagcagctggctgaggtgagggggagggtaactaagtgacct
cgggtggggcaggtcactgcccaggtactgttcaacagattccagactggagcctctgtg
ttctcttttacagccaacatgcccatcactcggatgcgcatgagaccctggctagagatgc
agattaattccaaccaaatcccggggctcatctggattaataaagtgagtgtaactcttt
gggttttcctgccactgttttaacccatgtacttctggagggaccaaagcttcagatgca
gctcaaaagggaagtgataacgggacaagcaggtgtttctcccagtgggtcctgcatgc
agggagtgtgcacggccccagcctgggcctcacttgcatgactcctgccttcttccecttct
tgaggtagggcacccacctgaaggcacttccagtttccagcagcaagactttccagcatc
tgcagagctggagttctgctctcctctaagcgagacccttacaaacatacacagcactct
gcagggctccaatcgaacaaatagaagactgagaagtgga >IGR2015a
gcctgggcctcacttgcatgactcctgccttcttcccttcttgaggtagggcacccacct
gaaggcacttccagtttccagcagcaagactttccagcatctgcagagctggagttctgc
tctcctctaagcgagacccttacaaacatacacagcactctgcagggctccaatcgaaca TABLE 5-continued aatagaagactgagaagtggatgctgctgggcagaaacgtgcctggcttagcagaggaca
aacgagttaatcttgcaccagtcactctggcccaagaagcctatagctggtgcacttggg
gcaacatagaccctatagacttagtagcaatgatagtattcataataatagctaatgctt
actgaacactccctgtgtgcctggcacctgctaagtatgttatttacattgtgtcattta
atcctcgcagtagtcctgtgggttagatcttactaatgtcatcattttcagataagtaaa
cagaggcactgagaggtagatcataagatcacacaaaaagtgatgaagccaagatttgaa
cttgaacggtctgactcagaaatctttactgttaaccataagtgatataataacagtaag
accttagacttcatatttgtcactgtgtccctacacatcctctggttttttaatcctcaaa
attttgttggatatgttttctcatttccgagaagagaaaa >IGR2016a
atcataagatcacacaaaaagtgatgaagccaagatttgaacttgaacggtctgactcag
aaatctttactgttaaccataagtgatataataacagtaagaaccttagacttcatatttg
tcactgtgtccctacacatcctctggttttaatcctcaaaattttgttggatatgtttt
ctcatttccgagaagagaaaactgaggggcaaagagatacagtgacaatgccagggttac
acagtgttcaccatccaagtctagcccagagctccctcagtggtatgaccaggacccct
gtgtaagagcccatgctcccaggtgtcctgaggagtcctttctaatggaagaagttctta
cttccatgtgggtgcttacaagccagagagaaacatcccagagcttcaaaaccagggctt
tgggggagggtgccctgtgtgggtcctagcacatgtgtaacaggcagagggaggtctttg
tgagctaataatgctgcagctcatccaaactaggtgtccctcctgagagatccagagtgg
tctgtttaagccagcctcaagatgggtgtccaagccagatgtcagggaaaaaggggaa
gtcagccttttctcagacctgtctggctgggcaggcctgggtctcagactcagccccaaa
gtctgtggtctctgacctgacacagccttatgtgtatgtg >IGR2017a
ctcatccaaactaggtgtccctcctgagagatccagagtggtctgtttaagccagcctca
agatgggtgtccaagccagatgtcaggggaaaaaggggaagtcagccttttctcagacc
tgtctggctgggcaggcctgggtctcagactcagccccaaagtctgtggtctctgacctg
acacagccttatgtgtatgtgtgtattgttcaggaggagatgatcttccagatcccatgg
aagcatgctgccaagcatggctgggacatcaacaaggatgcctgtttgttccggagctgg
gccattcacacaggtgtgtgcctgggactcaggcctaggaagcccagggtagagacaaga
ggaggcactcacgttaacacagaggctcttcactggggtccctgagctccctgagacaac
atgcagaattactgggaagaggggctggtggcagacttgtgtttctggagaagagagtcg
atcatctcagcaaattctcaaaggaaaagccaagatcttagaaagtgtgtggcttcagg
gggtttgtggctagatgaaagttctccctggcaaaagcatctgtgaaaagcagctgtaag
ccagggcactgaaagagacccaggtctgccttttttcttcgtgttgaccaaggcccttggt
ccaagcctcatgtggttggtggcctcctttatccttgaga >IGR2018a
aaagggaaaagccaagatcttagaaagtgtgtggcttcagggggtttgtggctagatgaa
agttctccctggcaaaagcatctgtgaaaagcagctgtaagccagggcactgaaagagac
ccaggtctgccttttttcttcgtgttgaccaaggcccttggtccaagcctcatgtggttgg
tggcctcctttatccttgagagatggagctctaggcccatctcagaacagtcagcccacc
catttagtaactgttctctgctgcccagtctgtgcccactctaccctctggctgctgata
gcccaaggaggaagactgggcatagtctgagacacagatagtacacttgggatatggg
gactctagtgcttctggctgggcccttcactgaagcccgctagatgtgttttaagccaagc
ctgggcatttgagaaggcccagggcctaggacctgcagagtgtcaccgggagtacctgct
ggttgaccactgtggctctctggtagcataagaggtcaggggtaccttgccttcctcct
tcaggccaggggcagctgaggatccctacccatggccctgacgatcctcttttttctcct
gccctctaggccgatacaaagcaggggaaaaggagccagatcccaagacgtggaaggcca
actttcgctgtgccatgaactccctgccagatatcgagga >IGR2019a
tctggtagcataagaggtcaggggtaccttgccttcctccttcaggccaggggcagctga
ggatccctacccatggccctgacgatcctcttttttctcctgccctctaggccgatacaa
agcaggggaaaaggagccagatcccaagacgtggaaggccaactttcgctgtgccatgaa
ctccctgccagatatcgaggaggtgaaagaccagagcaggaacaagggcagctcagctgt
gcgagtgtaccggatgcttccacctctcaccaagaaccagagaaaaggtatccaaggact
ctgggtccttgggaagccctcaggagggagggtagaaggaggtcagctggggctggaga
gcctgcaccaaggctgacagcccgtctgccccacagaaagaaagtcgaagtccagccgag
atgctaagagcaaggccaagaggaaggtgagtgtggtcctaagcagccaggcctttggtc
acctgtgggccaggtgagcagtggaagaaatgctaaggtgggcctgggcctaagctgct
ttctccctcgacagtcatgtggggattccagccctgatacctcctctgatggactcagca
gctccactctgcctgatgaccacagcagctacacagttccaggctacatgcaggacttgg
aggtggagcaggccctgactccaggtgagctggtccaggt >IGR2020a
cagtggaagaaatgctaaggtgggcctgggcctaagctgctttctccctcgacagtcatg
tggggattccagccctgatacctcctctgatggactcagcagctccactctgcctgatga
ccacagcagctacacagttccaggctacatgcaggacttggaggtggagcaggccctgac
tccaggtgagctggtccaggtctggcaggagaccccacagtcagtggatgactcttc
tcttggaggcatgtgctggcacatggtggcccattagtgcaggctgcagggttggtcgg
agggcgctcgatgtcttgcaaactaagaaagcacacaaccttgacctgtggcttctgctg
ttccccagcactgtcgccatgctgtcagcagcactctccccgactggcacatcccagt
ggaagttgtgccggacagcaccagtgatctgtacaacttcgcaagttgtcaccatgccctc
cacctctgaaggttggtgctcctggggcctggcctgcctgcttgactgtctgggtcctgt
gaagggcttcctgagagagaaagatgatcagaactccacctggcactgaattgattgag
ttgggcattgcccagtcttagccaccatagggggaggcaagcgacggggacactaggaag
gcagttcagagtgggctgcagtacagtgggggctggtgag >IGR2021a
tcctggggcctggcctgcctgcttgactgtctgggtcctgtgaagggcttcctgagagag TABLE 5-continued aaaagatgatcagaactccacctggcactgaattgattgagttgggcattgcccagtctt
agccaccataggggggaggcaagcgacggggacactaggaaggcagttcagagtgggctgc
agtacagtgggggctggtgagaggagggaaggggcaggggctgcatttttgggtgctg
gttctccttcctcctctgtagcccagcatctgagggtgaggaaggaagtagggtagggt
gggaagcggcgtggcttcagggttgagaggctgagtcaccaggccaggtcctgttctg
gaatctctatggcagataggtccaccgggagggtgtgtgtgtgtgtgtgtgtcagaga
gacagagagacagagaaagggcaggggatctggtgggctggaactggaactgcagggtg
agtgtggctgactgccagccaacctctctgctttccccatccacagctacaacagatgag
gatgaggaagggaaattacctgaggacatcatgaaggtaaagccccttcctacctgggca
ctcttgaagtgaccgtttctcagtgaggagagagaaccagtgaagcttccaaatcagagg
atgggtagctgctgttgtcacctggctgcttgcattgtcc >IGR2022a
caacctctctgctttccccatccacagctacaacagatgaggatgaggaagggaaattac
ctgaggacatcatgaaggtaaagccccttcctacctgggcactcttgaagtgaccgtttc
tcagtgaggagagagaaccagtgaagcttccaaatcagaggatgggtagctgctgttgtc
acctggctgcttgcattgtcccacaagtgccacattcacgtggcttgactggtgggaaag
ccaccatgggaaggaaggcaggtggggaggcctggcctctgacaggccgtcctgaagcaa
gccttggggcatcagacagctctgtgagtcaggcactatcagcgatgggtccctggcctg
catcctctgccccaacatgccccagccctgctagttcgggaaatgcacatcaggcttcaa
taatcagcctttaggatccgttaatatgatgatgctttatagaaaaagttagcaaatta
tcctccaggttttttttttctgcttcagtttttgaaagtgaatatagttttttgcagccgggg
gcagtggctcatgcctgtaatcccagcactttggaaggcgaaggtgggtggatcacctga
ggtcaggagtttgagaccagcctgactaacatggtgaaacccatctctaccaaaaatata
aaaattagctgggcctggtggcgcatgcctgtaatcccag >IGR2023a
tgcttcagttttgaaagtgaatatagttttttgcagccgggggcagtggctcatgcctgta
atcccagcactttggaaggcgaaggtgggtggatcacctgaggtcaggagtttgagacca
gcctgactaacatggtgaaacccatctctaccaaaaatataaaaattagctgggcctggt
ggcgcatgcctgtaatcccagctactctgaaggctgaggcaggagaatcgcttgaacctg
agaggcggaggttgcagtgagctgagattgtgtcattgcactccagcctgggcaacaaga
gcaaaactccatttcaaaaaaaagttttttgcagtagttgtacgccagtgtttccattagc
ccaaaaaattgagacatggatgtcgttccttatctctagcttttctagtcatctttttctt
gatttattatgctaacctttgttttaagccacattccctcttactatgtccttacacagt
tgagagggaagtcgtggagatgctataccagagagtgggtgtgagaggggtgggaaaatg
aattgaggaccagtgccaacatgcatttctgcctcctccctcccgggcccttgtcctgac
tgcagtgcacttctgcatcctatctgagattgtgaaaatggccaagggtgtgatactggc
tgagaggagctggctcattgagggcagggccacagggtga >IGR2024a
atgctataccagagagtgggtgtgagaggggtgggaaaatgaattgaggaccagtgccaa
catgcatttctgcctcctccctcccgggcccttgtcctgactgcagtgcacttctgcatc
ctatctgagattgtgaaaatggccaagggtgtgatactggctgagaggagctggctcatt
gagggcagggccacagggtgagtctgcactggaagggagttgatagcctcttgctcttct
gtccccagctcttggagcagtcggagtggcagccaacaaacgtggatgggaagggtacc
tactcaatgaacctggagtccagcccacctctgtctatggagactttagctgtaaggagg
agccagaaattgacagcccagggggtaagaaggccctggatccttatggcttcttagatg
agggagaaccacgtagggatggagaaagcttgggggcagggccagggagcagggcggtaa
agcatctggggtactgacacattgtgaattagctacggctgccatgccttaaggtttgcc
tgaagctgagtggatgtttactgctgtgctgggaagagcagaggccatgtctatggcctt
caggggtagggggaagcacacctgatgccaccgtcccctaccctcatacaaccttcttca
catcttctaggggatattgggctgagtctacagcgtgtct >IGR2025a
cattgtgaattagctacggctgccatgccttaaggtttgcctgaagctgagtggatgttt
actgctgtgctgggaagagcagaggccatgtctatggccttcaggggtagggggaagcac
acctgatgccaccgtcccctaccctcatacaaccttcttcacatcttctaggggatattg
ggctgagtctacagcgtgtcttcacagatctgaagaacatggatgccacctggctggaca
gcctgctgaccccagtccggttgccctccatccaggccattccctgtgcaccgtagcagg
gcccctgggcccctcttattcctctaggcaagcaggacctggcatcatggtggatatggt
gcagagaagctggacttctgtgggcccctcaacagccaagtgtgacccccactgccaagtg
gggatgggcctccctccttgggtcattgacctctcagggcctggcaggccagtgtctgg
gtttttcttgtggtgtaaagctggccctgcctcctgggaagatgaggttctgagaccagt
gtatcaggtcagggacttggacaggagtcagtgtctggcttttcctctgagcccagctg
cctggagagggtctcgctgtcactggctggctcctaggggaacagaccagtgaccccaga
aaagcataacaccaatcccagggctggctctgcactaaga >IGR2026a
gctggccctgcctcctgggaagatgaggttctgagaccagtgtatcaggtcagggacttg
gacaggagtcagtgtctggcttttcctctgagcccagctgcctggagagggtctcgctg
tcactggctggctcctaggggaacagaccagtgaccccagaaaagcataacaccaatccc
agggctggctctgcactaagagaaaattgcactaaatgaatctcgttcccaaagaactac
ccccttttcagctgagccctggggactgttccaaagccagtgaaatgtgaaggaaagtgg
ggtccttcggggcgatgctccctcagcctcagaggagctctaccctgctccctgctttgg
ctgaggggcttgggaaaaaaacttggcacttttttcgtgtggatcttgccacatttctgat
cagaggtgtacactaacatttcccccgagctcttggcctttgcatttatttatacagtgc
cttgctcggcgcccaccaccccctcaagcccagcagccctcaacaggcccaggagggg
agtgtgagcgccttggtatgacttaaaattggaaatgtcatctaaccattaagtcatgtg TABLE 5-continued tgaacacataggacgtgtgtaaatatgtacatttgtcttttataaaaagtaaattgttt
ataaggggtgtggccttttagagagaaatttaacttgta >IGR2027a
cccctcaagccccagcagccctcaacaggcccagggagggaagtgtgagcgccttggtat
gacttaaaattggaaatgtcatctaaccattaagtcatgtgtgaacacataggacgtgtg
taaatatgtacatttgtcttttataaaaagtaaattgtttataaggggtgtggccttttt
tagagagaaatttaacttgtagatgattttactttttatgaaacactgatggacttatt
attggcatcccgcctgaacttgactttggggtgaacagggacatgcatctattataaaat
cctttcggccaggcgcggtggctcacacctgtaatcccagcactttgggaggccgagatg
ggtggatcacctgaggtcaggagttcgagaccagcctggtgaaactccatttctactaaa
aatgcaaaaattagctgggcgtggttgcgggtgcttgtaatcccagctactcaggaggct
gaggcaagagaatcgcttgaacctgggaggtggaggttgcagtgagccgagaacatgcca
ttgcactccagcccgggcaccaaaaaaaaaaaaaaaaaaaaaacctttcatttggccggg
catggtggcttatgcctgtaatcctggcactttgggaggccaaggtgggcagatcacctg
aggtcaggagtttgagaccagcctggccaacatggtgaaa >IGR2028a
aacctgggaggtggaggttgcagtgagccgagaacatgccattgcactccagcccgggca
ccaaaaaaaaaaaaaaaaaaaacctttcatttggccgggcatggtggcttatgcctgt
aatcctggcactttgggaggccaaggtgggcagatcacctgaggtcaggagtttgagacc
agcctggccaacatggtgaaaccctcatctctactaaaaatacaaaaattaggccgggcac
ggtggctcacgcctgtaatcccagcactttgggaggcagaggcgggcggatcacgaggtc
aggagatcaagaccatcctggctaacacggtgaaaccccgtctctactaaaaatataaaa
aattagccgggcctagtggcgggtgcctgtagtcccagctactcgggaggctgaggcagg
agaatggcatgaaccccggaggcagagcttgcagtgagccgagattgcaccactgcacta
cagcctgggcgacagagcgagactccgtctcaaaaaaaaaaaaaaaattagccgggcct
ggtggcgggcgcctgtaatcccagctactgtggaggctgaagcacaagaatcacttgaac
ccgggagatggaggttgcagtgagctgagactgtgccactgcactccagcctgggtgaca
agagtgagactttgtctcaaaaaaaaaaaaaatcctttgt >IGR2029a
agactccgtctcaaaaaaaaaaaaaaaaattagccgggcctggtggcgggcgcctgtaat
cccagctactgtggaggctgaagcacaagaatcacttgaacccgggagatggaggttgca
gtgagctgagactgtgccactgcactccagcctgggtgacaagagtgagactttgtctca
aaaaaaaaaaaatccttttgtttatgttcacatagacaatggcagaaggagggacattc
ctgtcataggaacatgcttatataaacatagtcacctgtccttgactatcaccagggctg
tcagttgattctgggctcctgggcccaaggagtgttaagttttgaggcatgtgccatag
gtgatgtgtcctgctaacacacagatgctgctccaaaaagtcagttgatatgacacagtc
acagacagaacagtcagcagcccaagaaaggtcctcacggctgctgtgctgggtagcact
tgccatccagtttctagagtgatgaaatgctctgtctgtaccgttcaatacagtaggcac
tggcactagccacatgtgccagctaagcacttgaaatgtggccagtgcaataaggaattg
aacttttaattgcatttaataaactgtatgtaaatagtcacatgtggtcagtggttacca
tattgaacagtgcaggtagatactggactgggggcagatc >IGR2030a
tgatgaaatgctctgtctgtaccgttcaatacagtaggcactggcactagccacatgtgc
cagctaagcacttgaaatgtggccagtgcaataaggaattgaacttttaattgcatttaa
taaactgtatgtaaatagtcacatgtggtcagtggttaccatattgaacagtgcaggtag
atactggactggggcagatctgagggagaggggtttgagtagtgggaggacactgggga
taggggcttggggctatttacctgccatttttgagtagtttgctattttagcagccaacaa
taactattggtgctgaataccagccctgcagtgtagcatgagacaggtccatgcacacat
gcattaggaaaacaccttcatgaagcaggattctgcctgggctgatgcacacaacctcta
tggagggtaaacagtgtttctgaagaccgtagtttgggaaccccctgacatatgacaatgc
ccccttagataagctcaagttacaggaatgtctgagggtggaaggtgtggatatgtgctt
ttcctgtctccctcttcagtgtctggccatggggcataaacactacccagcagtaggtag
gctggccaagagaagccagcttgcatcaccagcatcatctagggaatggaatcatggcag
taatacgttgcttaggaaacaaaagctctatggacacatc >IGR2031a
ttacaggaatgtctgagggtggaaggtgtggatatgtgcttttcctgtctccctcttcag
tgtctggccatggggcataaacactacccagcagtaggtaggctggccaagagaagccag
cttgcatcaccagcatcatctagggaatggaatcatggcagtaatacgttgcttaggaaa
caaaagctctatggacacatcttccaccttctcagtcccagaaaccatatgtactgtgac
cccgctcactaggcccagccctcgggaagagtgtgggcccttgaaaaggaagactgagt
gagaaaatgatgagaaaactacaaaatgggcagaggtcagtctgacacattcattctctg
tcaagctcaggaagtactggtccctgatcttggagatgctgtgtgagtggcagggggact
cctgctgggtaaatattctatatgtggatgcctggacaggccccatcccaggccctgct
tgtcagaagctccccttgggccgagcgcggtggctcacacttgtaatcttggcactttgg
gaggccgaggcaggtggattgcctgagttcaggagttcaaaaccaggctgggcaacatgg
tgaaaccctgtctctactaaaaaaaaactaaccaggcgtggtggtgcatgcctgtaattc
cagctactgggaggctgaggcaggccaatcacttgaacc >IGR2032a
gccgagcgcggtggctcacacttgtaatcttggcactttgggaggccgaggcaggtggat
tgcctgagttcaggagttcaaaaccaggctgggcaacatggtgaaaccctgtctctacta
aaaaaaaactaaccaggcgtggtggtgcatgcctgtaattccagctactagggaggctga
ggcaggccaatcacttgaacccaggaggtggaggttgcagtgagctgagatcacgccact
gcactctagcctgggcaacagagcgagactctgtctcaaaaaaaaaaaaaaaagaagtt TABLE 5-continued ctacttggaagctccacttggatttctcaagaatagcttcacctgggaacagaggaatag
acaggatggacttttccagctccttcagggaccagccctttttaagatttggattgaggt
ggctagccacctgtggcttccatctgggttctcctagtgggtgatggcaggtggtgcaga
gcaaggtagagtggactgacgggaggaaagtgataccacccagaacaagcagcagctctg
acttcttttctcctgcccttcaatctaatccctgatggagggtaggcagtgagtatgtg
aagtcttaggcagctgtggaaatctctcaagttctaaaagcaaagttaattgcttgtaaa
ttaccaaaaagagagaggaattatgtccatcagcttccaa >IGR2033a
cgggaggaaagtgataccacccagaacaagcagcagctctgacttcttttttctcctgccc
ttcaatctaatccctgatggagggtaggcagtgagtatgtgaagtcttaggcagctgtgg
aaatctctcaagttctaaaagcaaagttaattgcttgtaaattaccaaaaagagagagga
attatgtccatcagcttccaatctccacaaccaagatggagtcctcaatttccccatccc
ctctgatcccaggagtcctaaatgattggtagcaattgcttggaatctcagggagggac
ctcaaaactctcccctggcccccatcacaatggagctgggtcctagggaccaagcctgga
gtagtgtgggatagagccagacctttcaggatggagagctgtcccatcacatcctaccaa
gacttcagccttttcctaggaaaagaaactaaataaggtctgacagctcacctaaaggtg
atggcagctgacactaccgagtcattagccaaacagtgcctgaaacggagcagtattagt
aagatctgaaccaagtttgtgcttaataattagatcattctaaggacctgacagtgcttc
tgtgggtcattctcaagagtttcagtataagcactaatggtggaagttctaggttgaggg
agctaggaggttgttgaaagatctgttttgctggggttgt >IGR2034a
agtcattagccaaacagtgcctgaaacggagcagtattagtaagatctgaaccaagtttg
tgcttaataattagatcattctaaggacctgacagtgcttctgtgggtcattctcaagag
tttcagtataagcactaatggtggaagttctaggttgagggagctaggaggttgttgaaa
gatctgttttgctggggttgtgatgagataactgtcatcaaggaccactttccactgggg
taaactgacaaaagtggtgctcagccacaccagctagatttctcatgttgggccaagttt
acagacatttgcgggcatttgtggttagtcatgggtttccttgccttaactccaaaaggg
tatagctggctggtcactttcattgggctggtttattcattcagctcacttggcaatagg
aagaaagctagaagctaataggcaaaccatcccttcttggtgtgtcagcttttcaacatct
ctcagtgcactgtgtgcagggtgttgtgaccattacaactccaaaggaaagagctttctc
tgattttctggaagtctccagtgggcctgccaaagtgggaactgaaatcctggggtag
ccctgggaagtggagtttttttctctaggagtgatgtctcctggttggtggggctgggaa
acagccaggttgtcattctctgggaccacttgatctttca >IGR2035a
ggtgttgtgaccattacaactccaaaggaaagagctttctctgattttctggaagtctc
cagtgggcctgccaaagtgggaactgaaatcctggggtagccctgggaagtggagtttt
tttctctaggagtgatgtctcctggttggtggggctgggaaacagccaggttgtcattct
ctgggaccacttgatctttcacactgtgtacagatccaaaactctgcccttatacttgga
gggggaaaggggggtacagatgtcctccaggcagtcctgttggagcacccagggctaatata
gtgaccctatagaaagcttttgtctctgtcagatgtaatgctgttccttaacttgggcac
aactgatcttccaattcatcagaactcagcactaaccttccccagttctgctggctgtc
acagaggaaggaggcctgggtgggagaaggggaagctggtgccctccttttccagggt
gaaagtacttggcagggtggagcttggctttatcatccggagctccccttgtggggccaag
tctaaggcctcagaagggtatagctggctggccgcatagttttcctagctccaggcagct
ctcaagagacccatttatgctggttttctcagggtaaggagttacagaagtccacctctg
ctggctcagtggtaagacacaagcctgcagagtctgctga >IGR2036a
gagcttggctttatcatccggagctcccttgtggggccaagtctaaggcctcagaagggt
atagctggctggccgcatagttttcctagctccaggcagctctcaagagacccatttatg
ctggttttctcagggtaaggagttacagaagtccacctctgctggctcagtggtaagaca
caagcctgcagagtctgctgagtgaaacttcagctggggagatactggaggctatggagc
aaggacatggggactgaatgaaagaggggaggcagacgtccagcccaccattcctcaccc
aaggagatgatcccacaagctcacaaatgagcagaactggaaaagacctcaaagtgtggc
tggataatggcaacacaggcctcgagtgctcactttgtgctgggtgctatgccaagcacc
acgtgtgtaccacggcactggcacccaccacggcccttgttcagaccaggaaaccaa
ctctcaccacctaatcagtatggagccttggttccaacccacatcatctatctgtgccca
gaatccaggttgttccatatcaggctgcctgagagaagaacacggaggcctgcacaaga
agctggggagagctagcaaggggcagggcccgagcacccttatgccaagcaagcacttgtg
gatgctgagggaaggcggcaaaagctgcagctgctgtgct >IGR2037a
atggagccttggttccaacccacatcatctatctgtgcccagaatccaggttggttccat
atcaggctgcctgagagaagaacacggaggcctgcacaagaagctggggagagctagcaa
ggggcagggcccgagcacccttatgccaagcaagcacttgtggatgctgagggaaggcggc
aaaagctgcagctgctgtgctgccctgccttcagctctcctcccttcccccagcacacac
accttccaacaccccctggcaacatggctctgccgctacaggccccagggccccaacaggg
tagggttttgccccacctatgccctggaggccacctgcagtttcgaagggtggggcccag
ggggccgagacacagacaggcttgtaacttggcctcagtgcaggggggcagcttggccaca
ccaggcctgtttggagcaaacgggggactctggcctgctaggcctttatctcagctcccag
gatcaaagaggacttttttagccatgtttctgtctcagcaagacaacctagtctcctgttc
tgctttaaaccagaccctctgtttgggtcctggagttcctcagaggtctggaccctggatg
gctgtgagactcaggaccatgcacagatgcattctcattcccagccaccaggctcgggtc
agaccctatggctctggtgggcctaattcctggttttcttg TABLE 5-continued >IGR2038a
gccatgtttctgtctcagcaagacaacctagtctcctgttctgctttaaaccagaccctc
tgttgggtcctggagttcctcagaggtctggaccctggatggctgtgagactcaggacca
tgcacagatgcattctcattcccagccaccaggctcgggtcagaccctatggctctggtg
ggcctaattcctggtttcttgatccctgagaacacctggcacctctggctgctggccagt
tgccaccttacatcaggcgggcgctggattcacctgcaggcttcctttagggaaggccc
tccccctgccctcctgtgccagcccagaggggcagcctgggtgaggtcttcacatccattt
cgggccaaatgccttggattggctggatcccctcctgtttctgccctccttctttccttc
aaagcaacaaggttgtgggggtgtccagttctgctaccacctctccctcacactgtcaat
ctggaatttgtccagaattggggcccaagtagtgagttcttacacagtggttaaacaaac
aaacaaacaaaaacccacacaactcagctacaccttggctcagagaggccatgggatat
accgaggatctcagatcaggagggaggcccctggagaggtgtggcggggatcatgtgctt
ctctggtttcttggagaaagctgactttgtgtaacaaggg >IGR2039a
ggggcccaagtagtgagttcttacacagtggttaaacaaacaaacaaacaaaaaccccac
acaactcagctacaccttggctcagagaggccatgggatataccgaggatctcagatcag
gagggaggcccctggagaggtgtggcggggatcatgtgcttctctggtttcttggagaaa
gctgactttgtgtaacaagggaggcatatggacatggagttggtgtttggggatgtggga
accattaggccagaattacaagaagtcctgtcatgtcggccacactaggcaacagtgga
ctggggcaggggctgatgacctgattgtggaggcagtggagggctgtttctgctggggac
ccagggctcccctccaagtgctcctgcttggcttgttgggatggggagaggagctggagt
tgggatggggagaggagctggagttgggatgggtcacagcgaaggctacagcctggcatt
cccatatgggtagggtggggtgggtgggacagggaggaggacctgaaggggtgtcca
actttccgagacttggaacagcctggtgagtgttcatcaccattcttctgtcataggtgg
cgagcagccagagttctgggcacaggagaccatctaccccccaagcttgtgcggcctgcct
caggtcactgaagaggaccccatttttggtctttggccat >IGR2040a
gggtggggtgggacagggaggaggacctgaagggtgtccaactttccgagacttggaac
agcctggtgagtgttcatcaccattcttctgtcataggtggcgagcagccagagttctgg
gcacaggagaccatctaccccccaagcttgtgcggcctgcctcaggtcactgaagaggacc
ccattttggtctttggccatcctaagacttgtacaatgagccctgggcctcccttc
tctgaccagtgacagccctcacaggcaaagcctcaccctctagggcctgtcccttcctgt
ctgccagtccccacagggtctgcggggtacccaatctcgccaaccagactggaagctccc
cagggcaagcagcttatctcttccatattctcacagtgttcagccaggattggcacttc
agagcatctcctgctgctcagcagagatgtagttagcatctctctatagtagcactttct
gagtccctccctgggggaaccaggctagactctggggtccagaggagcaggcaggctga
gaggcaaaaagggcacagaggaataaccaaccctgcccctgcagtagagccctgggcaaa
acaggccatgaccaaccagcagccaaggtcaaagtccccagaacaagggccagtgtgtgc
atgacatgcagcaggaccgcttgtctctttcggcagtact >IGR2041a
accaggctagactctggggtccagaggagcaggcaggctgagaggcaaaaagggcacaga
ggaataaccaaccctgcccctgcagtagagccctgggcaaaacaggccatgaccaaccag
cagccaaggtcaaagtccccagaacaagggccagtgtgtgcatgacatgcagcaggaccg
cttgtctctttcggcagtactggagatagaaggctgagtcattaacaactttcttttatt
aaaaatgtacataagtaaaaggaacatggtttaattgtgcaaagagtaagaaatacagat
gagcaaataacacgtattaaagccacctacgatataccaccccagaagtaaccaggctgtt
gaattttttagagactgggtgcaaacacatttttcactcccttgtgcatatatctggga
gctctgccatatacagacacagacgcggtgtccacaggcgatgcctctgctgggaatgct
gcaagcaggagtctatcctttcctggtactggctcggggccctcctcagcgcccaggtc
actctagcatccaggagtccaaaggcccggctgtgcaggctgcagaggtgatctagagta
gattaggaggtgcaaaaggcttggagataggctgaccaactgttccagtttgcttaggac
tgaggagtttcccaggatttgggactttcagtgctaaaac >IGR2042a
ttcctggtactggctcggggccctcctcagcgcccaggtcactctagcatccaggagtc
caaaggcccggctgtgcaggctgcagaggtgatctagagtagattaggaggtgcaaaagg
cttggagataggctgaccaactgttccagtttgcttaggactgaggagtttcccaggatt
tgggactttcagtgctaaaactgggaaagtcccaggcaaaccagggccagttggtcaccc
tccctgagggcaaaggctttgtcctgccctcctgccctgtgctcccatctgccctcc
tgctggggttctggatccccatccccacaccaagcagcccaggacagaggcctggctg
gggccttgcctcccgtggaagctcctgaaagttccagcctgaggcctagggagggacagg
ggaaagggaataaattaaggcagacagtctgtcatcacccaagaaaaagggccaggtgaac
tgtggctgttaagggcagctagggatgtacaagcagaagggttccaatacttggctggcc
accccctccagccctggagctgagtgtgtggtcccagaggccccagagccagagaagtgc
agggtgtctggattgaaaggcctcagctccctgggctcccagagccctggtgcctcaggc
cttaccttcccctcctccatctccacaccccctggcact >IGR2043a
tagggatgtacaagcagaagggttccaatacttggctggccacccctccagccctggagc
tgagtgtgtggtcccagaggccccagagccagagaagtgcagggtgtctggattgaaag
gcctcagctccctgggctcccagagccctggtgcctcaggccttaccttcccctcctcc
atctccacaccccctggcacttcctgctcagctcttctctacctaagactgggagcagag
gatgaaggaagaggaatccaggacagaccgagctgaaagaggagcaggcaggtgggaggg
gacttgggtagaaaggacctctctgatagtggcaggaacatcctgactgtggtctggccc
agccggctgtctatgcctgaggatgcctgaggatggggggcccttggaaaactcagaaga TABLE 5-continued gaggctaggtgtggaaggcagagtattggtccacagtggaataaagaggtccacgtccta
atgcatgagcctatgaatatgttgctacatggcaaagaggaattaaaactgcagatggaa
ttaaggttgctaaccagctcacttgcaaatagagagattaccctggattattggtgtggg
cccagtgtaatcacaaggggttcttaaatgaagaaggaggaggcagaagggtcagaaccag
agagatcgcattgtgaaaaacctgaccagccagtgctggc >IGR2044a
tgttgctacatggcaaagaggaattaaaactgcagatggaattaaggttgctaaccagct
cacttgcaaatagagagattaccctggattattggtgtgggcccagtgtaatcacaaggg
ttcttaaatgaagaaggaggaggcagaagggtcagaaccagagagatcgcattgtgaaaa
acctgaccagccagtgctggctttgaaagtggaggaagggggttgcaggccaaggaatgca
ggcagcctctaaaagctggaaagggaaaggaaaggaaaaggggattctccactagagcccccca
ggaagaaatgcagctctgttgacaccttgagtttagcccagtgagacctgttttggactt
ctgactacagaactataagaaaagaaacgggccaggtgcagtggcttacacctgtaatcc
tagcactttgggaggctgaggcaggcagattgcttgtgcccaggagtttgagaccagcca
gggcaacatagtgagaccctgtctctataaagtatacaaaaaaattagccaggtgtggtag
cacgtgcctttagtcctggctacttgggaggctgaggtaggaggatggcctgagcccagg
agggagaggttgcagtgagtcaagattgagccactgcactccagcctgagtgacagagca
agaccctgtatccaaaaaaataaataaataaaaaattgtg >IGR2045a
tgtctctataaagtatacaaaaaattagccaggtgtggtagcacgtgcctttagtcctgg
ctacttgggaggctgaggtaggaggatggcctgagcccaggagggagaggttgcagtgag
tcaagattgagccactgcactccagcctgagtgacagagcaagaccctgtatccaaaaaa
ataaataaataaaaaattgtgttgtttaagccctgtttatgataatttgttagagcag
caataggaaactgatccactgggaaaccatttgggggatgcagctgcccaaaatccctgc
acgtgggttggactcagcctcacaaggctctacagcctctctgtgaaagactccattccc
tctgggagaagctcagactctaaagccctgggcagggaatgggcctccatggcatggagg
gggtcaagaaggatgccccccaggatagtgcctctgctggacctctctataggaagcagc
tgcctctttgagcccctccccaaacctcagtgagctgaggtgctggctctgagtggtca
tggaggggcttgcctgaggtcaggccacctaggacagctagtcagaggccacagggcttg
gcttaagattcccaggaaggagttgcatggcccctccacacatccgcaatactcataaca
ctctcagtccttggccttactaagggaatactaagggggac >IGR2046a
cccaaacctcagtgagctgaggtgctggctctgagtggtcatggagggggcttgcctgagg
tcaggccacctaggacagctagtcagaggccacagggcttggcttaagattcccaggaag
gagttgcatggcccctccacacatccgcaatactcataacactctcagtccttggcctta
ctaagggaatactaaggggactcagtttagctctggaaaagctaggactactggaaaaaa
aagtatagaggaaaaaaaatagttactggatgccagccagatctgcaaaaagtccccact
ctgccacttactagctatgtggcctcaaataagccactagaccttttgtagcctcagttt
cttcatctgtaaaatgggtataacatcatttgtcttatctgtctcacagggtgtgtgagt
ctcaggtgagataacacacgagaaaacattgtgccgcacaacttgagatgcaaacagtaa
cgatcacaaccccacatgccttttgatagggtgaatgatcacagcatcctgtgttaggga
ggaaagggtgagcacagacgcttcaaaactctgtcttacccataggcagaagggtgtagc
ctggccaggggagaaaaggacccagccactgccaccgccccgcagctcacaccggatgtg
cgacagagccaccatgcagccccacaggatgtcctccaac >IGR2047a
cttttgatagggtgaatgatcacagcatcctgtgttaggaggaaagggtgagcacagac
gcttcaaaactctgtcttacccataggcagaagggtgtagcctggccaggggagaaaagg
acccagccactgccaccgccccgcagctcacaccggatgtgcgacagagccaccatgcag
ccccacaggatgtcctccaaccactacagactgtggggctttgctttttttttttttttt
ttttttttttaagaaaaaggtttttctagtttccttctacattaaaaacaatccctccttctc
ataaagcacaatttttacagaggaaaagggagatgtgaaactatacacaattcaaatctaa
ttaatatataattttttttgtggaatacagatggagggaatacatcacaatactaaaggtg
attatctttggatgtgtgggattacaggtgattatatattttttatatttctatagtttaa
aaatattccatgatgacctataattactttttacttattttttttgagacaaaatctcaccct
gttgaccaaggctggagcgcagtggtgcaatctcggcttagtgcaatctcggtgtagtct
cgacctcacaggctcaagtgatcctcccacctcagcctccggagaagctgggactacagg
tacataccaccatgcccagctaattttttgtagagacagg >IGR2048a
ataattacttttacttattttttgagacaaaatctcaccctgttgaccaaggctggagcg
cagtggtgcaatctcggcttagtgcaatctcggtgtagtctcgacctcacaggctcaagt
gatcctcccacctcagcctccggagaagctgggactacaggtacataccaccatgcccag
ctaattttttgtagagacaggatttcgccatgttgtccatgctggtctcgaactcctgag
ctcacataatcctcctgcctcggcctcccaaagtactgggattataggtgtgagccacct
tgactggcctataattacttttataatcagaaaaaaaattataaataaatatgaaaagtg
ccaggaactttcttttgtggagccacacactgggctcaaggaatcatttgagctgggttc
tgcaggggtgggagtcttggcgcgggccctggtccttgctgtgtgaccctggagactcac
tactttccctccctggcctttgtttgcctggtaagacaagatgctccctagggtcctttg
cagcttaataagtaaagtattcgccttggtctcatccatcccagctctttgcccagcttc
cagtgactcctctgtgcctggagagaagggcaagcgccttactcatgccttgaggttgct
gaccacttccgtcaccagcctcgctccttccagacctgcc >IGR2049a
ttgtttgcctggtaagacaagatgctccctagggtcctttgcagcttaataagtaaagta
ttcgccttggtctcatccatcccagctctttgcccagcttccagtgactcctctgtgcct TABLE 5-continued ggagagaagggcaagcgccttactcatgccttgaggttgctgaccacttccgtcaccagc
ctcgctccttccagacctgccctgggagtccctgcctcctggccttcacctgcatcacgg
tctgcacttctcagagccctgcccttccttgaagaacaaagcctggccaaattgtgtcag
ccttctggcctgcagtgaccectgcttacattgtacataacaatagctataacttattga
cattaacttcaggtcacatagcaaaagtgctctcatttaaatcttaggccaccagaggat
ccatagactaaaatgttaacagcatctcctggagtttgtggagtgtggtgaccctatgtga
tcctcctgtgccactgagagatatattattaacccagtttcactgataagataactgagg
ctcagagaggtcaagtaacttgcccatggtcacacagtgggtccatggcagagctgggag
gtgatccctagtcagttccctccaagtccaggattttctcactcccacaatggtgtctcc
cttaatgactctcacattccagcctctgagggcaggaagg >IGR2050a
gatatattattaacccagtttcactgataagataactgaggctcagagaggtcaagtaac
ttgcccatggtcacacagtgggtccatggcagagctgggaggtgatccctagtcagttcc
ctccaagtccaggattttctcactcccacaatggtgtctcccttaatgactctcacattc
cagcctctgagggcaggaagggtatgttctgagttgaacacacagagagcactcaatgat
gtctggtggtgaagatgttaatcatgagctcaatcaaggtttatcattaaatcaacaagt
cttcctagtgtgtctgggagctctggggcccaggacaggcctactgtagttcagtgttg
tattctggcacctggtggtttctggcacatagcccatgttcattaaatgacatgaattga
ttgtccattcaaataataaaacaataaataaataatactagctaacaggtatggagtgcc
tacaagccagccacctcagggagtttccaggacagttgaggagaaacataacactgttga
caagagctacaacgtagggttttacaccaaaacagtgtctacgtaaacagtgtctatcaa
agagagaaaatgatgggcagacaccctgatccttcccacagtgctaaaggccatgccag
ccactgtccccattacgacttgcatatactgactgccgaa >IGR2051a
ggagtttccaggacagttgaggagaaacataacactgttgacaagagctacaacgtaggg
ttttacaccaaaacagtgtctacgtaaacagtgtctatcaaagagagaaaatgatgggc
agacaccctgatccttcccacagtgctaaaggccatgccactgtccccattacgac
ttgcatatactgactgccgaagcacacaaacctgaattttccgtctgcatccatcgttct
gtctgttcggatcacatctggatactactgttgcctctccagactggataaccagtctgc
tgagggccagaagatggtgagatgaaactagtcatgtttacttggagaagagaaatgaa
gaccgtctttaacacctgacaggttgctcttcccaagagggggccagagggcaacagccat
ggtcaacagctccaggcacccctgaggaagcctgctccagctggcagggttgtctggcaa
gggaccagtccctcctctggagaagtggtgagcccagtgggctgcctctccagcaggatc
ctgtagagaccttactctctacaatgcacactccacacacttgctcacttgacaaacact
tattataactgtcaccctgggcccattccaggttagggacataaggatgaataaaacaag
gtctgtaccagtagagaacatcagtcccctaggggagaaa >IGR2052a
gagaagtggtgagcccagtgggctgcctctccagcaggatcctgtagagaccttactctc
tacaatgcacactccacacacttgctcacttgacaaacacttattataactgtcaccctg
ggcccattccaggttagggacataaggatgaataaaacaaggtctgtaccagtagagaac
atcagtcccctaggggagaaagtcaggaaagcctcatcctgagccttcgactccttactg
tccatcctctaggctcctgtctcagcttctgctgaaggctattttcttccttgtattctg
cagtgaccaggcatatggcagataatcaacaaatacaggcatccctgaagagggtatcct
gggataaaagccccagctggatcagtgctatacaggggccaactgggggtgggttccagg
cagggtcatttgcaagggtccctctgcccttcaagtcctgccagacaggccttggccat
ggtttcttcctgcccctgtccctgaccacagttgatctcccctggctgttatgaaatgt
caaagaatgtcctgcaatcctaaattccataatgatctttatcttctgttccctctgagg
ctcctcaatctgcagtaacagctgtggttcagcaagcagtgcggcactctggagtgctgt
tctgaaacagggccggcgtggggcagagctcatctgctgc >IGR2053a
cccctgaccacagttgatctcccctggctgttatgaaatgtcaaagaatgtcctgcaatc
ctaaattccataatgatctttatcttctgttccctctgaggctcctcaatctgcagtaac
agctgtggttcagcaagcagtgcggcactctggagtgctgttctgaaacagggccggcgt
ggggcagagctcatctgctgccctatccattcactgtgctgttcagggctagagaagatt
catgtgtgtatatgcttttttaaaaattgtgaaacaataattatgcagaaaatacataga
atatatgttcagtttaacaaataatcataaagcaaatctctataaaaccactgctgctct
gcagtgacacctgcttccccctaagtcgtgcataacaatagctacaatttactgaccatg
aacttcaggtcacacagcaaaggtgttctcatttaatctttggccaccagaggctgcata
gactaaaatgtgaacagtgtccctgcagttgtggagtgtggtgaccctattggatcttc
tcacgccactgagggatatactgttttctgtagagaagtccagcagagtcactgtcctgg
ggggcatccttcttgatcgcccccatgccatgaaggcccattccttgcccagggctctag
agtctgagcttctccaagagggaatggagtctttcgcaga >IGR2054a
tcccctgcagttgtggagtgtggtgaccctattggatcttctcacgccactgagggatat
actgttttctgtagagaagtccagcagagtcactgtcctgggggcatccttcttgatcg
ccccatgccatgaaggcccattccttgcccagggctctagagtctgagcttctccaaga
gggaatggagtcttttcgcagagggctgtggagcctcgtaaggctgaatctaaccacgag
caggatttggggcagctgcatatcccagatggtttcccagtggatcagcttcctgttgc
tgctctaataaactaacataaacttaggggcttaaaacaacacaaatttcttttcttata
gttccgtaggtcagaagtccaaaacaggtctcactgggctaaactgaaggtgtcagcagg
gctgcattccttcctgggggctctagtagagaatctcttttccttttcttcccctttccagc
ttttagaggctgcctgcattccttggcctgcggcccccttcctccaccttcaaagccagca TABLE 5-continued ctggctggccaggtctttcatatattgcaatctctctgcttctgcttctgacccttctgc
ctctctcttctccatttaagaatgcttgtgattacattgggctcacccaccccagtttct
acccaataatccagggtaatctcccaaacttaaagagaga >IGR2055a
tccttggcctgcggccccttcctccaccttcaaagccagcactggctggccaggtctttc
atatattgcaatctctctgcttctgcttctgacccttctgcctctctcttctccatttaa
gaatgcttgtgattacattgggctcacccaccccagtttctacccaataatccagggtaa
tctcccaaacttaaagagagaaaacaatactagcaccccaaagcacctacgtgttcccc
tactaatcacaaccccaaccctcccttctgcataagtagacatttgtaataattctgtgc
ttttttgtagtttgacctcctctgcatgtatccttaacaatacagttttgccagctgttaa
attttttgctaaaaggaattatactgtatgcattcttttgtaggttttattcattgatgag
tcatttgttattacagtattattatccaatatgacaatattacagttattgcaagtcgct
gtagttcatttcactccaggaacactgcacaatttatttgtactctccacttttgatggt
catttggacattttctggtgctgtgtgggtattctggtgcacatgggtaagagtgtggtt
tgagaagattctgaggagtgggactcttgggttacagggtatatatatgttttcatcttt
taaaaaatttatattattcatttttttaaagactagtca >IGR2056a
gaacactgcacaatttatttgtactctccacttttgatggtcatttggacattttctggt
gctgtgtgggtattctggtgcacatgggtaagagtgtggtttgagaagattctgaggagt
gggactcttgggttacagggtatatatatgttttcatcttttaaaaaaatttatattatt
catttttttaaagactagtcactgggcgcggtggctcacacctgtaatcccagcactttg
ggaggccgaggccggtggatcatgaggttgggagattgaaaccatcctggctaacacggt
gaaatcccatctctattaaaaatacaaaaaattagccaggcgtggtggcaggcgcctgta
gtcccagctactcaggaggctgaggcaagagaatggcgtgaacccgggaggaagagcttg
cagtgagctgacatcgcgccactgcactccagcctgggtgacaaagcgagactccatctc
aaaaaaaaaacaaaaaacaacaacaaaaaaagactagtcaagggcagtagtgagaagggg
gaaaagagtagaacaaggagttcgatctgtaactgactgtgaagtcaattgagataattc
actaccttcagatcagccatgttttcatctttaccagatcacttatatgctttattttct
ttacttatatactttttaatcctgaaagtgtttctcaggg >IGR2057a
acaacaaaaaaagactagtcaagggcagtagtgagaaggggggaaaagagtagaacaagga
gttcgatctgtaactgactgtgaagtcaattgagataattcactaccttcagatcagcca
tgttttcatctttaccagatcacttatatgctttattttctttacttatatactttttaa
tcctgaaagtgtttctcagggaaacagtggtattacacccagttgtttaggtagaagaaa
tggggtatgtctgcccttacagtgtgaccttcccaccttctgtcttcagaaccctgtccc
ctccacccagatagccctgtgccctctggaatccacaggctggcccctcagtagcctcc
ctaccttgcagttgggtgggggtgggaggaggtcaagaaagaggaagtgaaaaccaaat
acaagggctacagagaagtccggtccacaaacctcaatgttcagcagcacacgctgtga
gaaaggaatgtgcaagctgtttgtggagcatgccttgggggtgccaaggccactggtgca
aaggtgtgcttctggacataagtcactccacacaatgctcaccccaaccctgtgaggtac
ggtactgtcatccccatgtcacagaatgaagacactgagctgcacggacattgagtgtct
gtcaatacagtgcaatggttaatagcatgggatctaggtc >IGR2058a
tttgtggagcatgccttgggggtgccaaggccactggtgcaaaggtgtgcttctggacat
aagtcactccacacaatgctcaccccaaccctgtgaggtacggtactgtcatccccatgt
cacagaatgaagacactgagctgcacggacattgagtgtctgtcaatacagtgcaatggt
taatagcatgggatctaggtctgtttaaattgggtttaaattctgacttccccacttact
agtggtgcagtcacctgggccattactgacttccttggtgtcagtttctgcacctgtaa
aatgggctaattggctcacagggttgttgagagaggtaaaagatgtaatgtgtagaagg
agcttagtcaagtgccaagcacaagggagaacccagtggaactaaaatgagcagagctat
gaaatgatgaccattatagagttcaaggttgacagggtggaatgggggttgtcctggca
agctgggaccaggccaccaaggtgctggtttggtgctatgtgagaatggaatgctggcca
ggtggactctgaaacatggacacctggacagtcctcccactgaccttgtccacctttgtc
cggagctctctacctatctgtggctgcttccaaggacggtgatttctgacagaggcagct
ggaccttggcacatgcagaagtttcagctcagcatcagtg >IGR2059a
aggtgctggtttggtgctatgtgagaatggaatgctggccaggtggactctgaaacatgg
acacctggacagtcctcccactgaccttgtccacctttgtccggagctctctacctatct
gtggctgcttccaaggacggtgatttctgacagaggcagctggaccttggcacatgcaga
agtttcagctcagcatcagtgctggccttcaggaggccgcattggcaggcggcagcagtg
acagccaatgggcagcaaagcttgttgctaaggtcactgtgagccttatttggtgacaca
gggctgaccctgcattcacctctgagaaccctgggaaacgccaaccacagatgtgaaata
tgaacatctcaaaaccacaactgcatttcctttgagaaaagattcggctgtcctcctctc
cagcctgcctccctccgctggatgtcttttgtacaatggctcactactgcaagaggcaag
agcctaggctacaagaagagtctgctacaagctagtcctgggcaggcctggacagggaga
gggcaggggctgctgtgcaggcggccccaggaccttcaaggacctccaagacttccgttc
acacccagcagctgccaaccccctgcccaggcctcccccaacacagccggagggcctgttc
ctggcccccacttcctgcagccttgggaagccggctagctt >IGR2060a
gtctgctacaagctagtcctgggcaggcctggacagggagagggcaggggctgctgtgca
ggcggccccaggaccttcaaggacctccaagacttccgttcacacccagcagctgccaac
ccctgcccaggcctcccccaacacagccggagggcctgttcctggcccccacttcctgcag
ccttgggaagccggctagcttgagaaaggcgtgtggcactcatggaggaagtgggccggc TABLE 5-continued actggggctctcaccatctgcaccagccacaccgcttcggtgcagcctggagctcaaacg
gttggcggtttcagttttttcacctcccttttggtgcatcttccagcttatcattaaataag
taaaactgttgctccacccccagacaaatgtgggagggaagttgtgtcttcaatatttccc
aaataacactcactgctccctcccattcatacagcaccttcggtctgggagctgtgctc
acatctgccatctcattacatccttgcaaccctggcaaaggtaatgactgagctcacacc
atgtgtcagggacatgaatgaattcacagaattcactgtaattgtccccattttacagaa
gagaaaatgagacagagaaattcagtcattggctcaaggtcatcacataactaggatttt
ctcccagatggctgagttccaaagtctgccctattctctt >IGR2061a
atccttgcaaccctggcaaaggtaatgactgagctcacaccatgtgtcagggacatgaat
gaattcacagaattcactgtaattgtccccattttacagaagagaaaatgagacagagaa
attcagtcattggctcaaggtcatcacataactaggattttctcccagatggctgagttc
caaagtctgccctattctcttctgctacattgcctccatggcacatacacaagaatgagt
tccatttactgatgagaaagtgaggctgaggtgaaagggtggtgtggggcctgaggtcag
cgttgcttcctcagtccacatctcctcccagaggatggtccaccaacgtccttcatctgc
cctccccctttaaaaaccactgtcagcccggcacggtggctcatgcctgtaatcccagca
ctttgggaggctgaggtgggtggatcacctgaggttgggagttcgagactagcctgagca
acatggagaaacccgtctctactaaaaacacaaaaattggctgggtgtgatggtgcatg
cctgcaatcccagctactcgggaggctgaggcaggagaattacttgaacccaggaggcag
aggttgcgatgagccgagatcacgccattgcactccagcctgggcaacaagagtgaaact
ccatctcaaaaaacaaacaaacaaacaaacaaaaacactg >IGR2062a
ctactaaaaacacaaaaattggctgggtgtgatggtgcatgcctgcaatcccagctactc
gggaggctgaggcaggagaattacttgaacccaggaggcagaggttgcgatgagccgaga
tcacgccattgcactccagcctgggcaacaagagtgaaactccatctcaaaaaacaaaca
aacaaacaaaaacactgtcatgcccccaccgccagcttgtctccctttcttttttag
gtgtggcccacagagctcagtgccctgcctatctggaagagctgtgaagcccatctatg
taggtaacggaggcaaagcaagggctagggagagtgtgccatgtgggacacctcccccta
tcacctccccactgcctgcacacactggggacagtcaaagcattcctcaggctgggggta
ggagctgtgggcggaagagctggggcatctgttcacagaatcctcccctgaagttgctcg
gaggggctgggatgcagtccagacactggggagcctgatgcagacgcctccctggagcac
tgtccttctcttgggctcttcaagcctgccctcactcatgaacacatatttttttgtgtgt
acttcctgcatgccaggcactaccaggcactgtggatgcacagtgaacaacacagacca
ggtccacgcgtcacagactttacttccctgagggaggcag >IGR2063b
cagacactggggagcctgatgcagacgcctccctggagcactgtccttctcttgggctct
tcaagcctgccctcactcatgaacacatatttttttgtgtgtacttcctgcatgccaggca
ctacccaggcactgtggatgcacagtgaacaacacagaccaggtccacgcgtcacagact
ttacttccctgagggaggcagacattaggcaaataatcacatggatctctgaaaaacata
gctcctacgagagggtgcaacttcaggggtcttaacctacaaaggagtgtgtgggattag
ggggttaggcgcagctgttctaaggatgagacatttcaggtgaggagaggaatgggtgga
gttggcagtggggctggttctcggctctccccgactgccctccttccccgcattccagtc
gcttcaggaaatctgccgcttccatgagagcttcttttggtggtgtcttccaagctgctac
caagcgatggctttgccagctgttgctttcagtgtttgtgcctgggtgagcacagccggt
atgaaatggcccagattaatcgagagccaggccctcctaaagtacctctgaaaagagtt
tttcagcataagcatgacattagcttttcctagagaggaaaccaccccggggctgacag
caagcaggccaggcttaaaggaagcaagtgcagcgctggg >IGR2064a
ctgttgctttcagtgtttgtgcctgggtgagcacagccggtatgaaatggcccagattaa
tcgagagccaggccctcctaaagtacctctgaaaagagttttttcagcataagcatgaca
ttagcttttcctagagaggaaaccaccccggggctgacagcaagcaggccaggcttaaa
ggaagcaagtgcagcgctggggcccctccatgccctgctgcagacaggacaccctcactg
ccttcccccaacatgctccccactcccactcctgcttctttctccctggggactctcc
ttgtggaaaagaaaccccaacagtaggggagcgagtgaaactgaaaatgaaactgtga
tttacagtttcattttccagtttcaatttagaagcagctctgccagcttccagtgcccg
tgcctcagggcatcacagaggagctgaggggcaggaaaaagtgttccagccagcaagcac
cctgctccctgggcaccctcagagggcgggtactggactggtagaacccactgagcaggg
agttgttgcaatgccgattcctggctctccaggctctgaggccgtacgtttgggcccttt
ggtgattctgatgcaggctgtggacctcaccatggcagtcgtggcctcagagaccatcag
aacagctagagcacacctgaggcacggcctcatcctctcc >IGR2065a
cagagggcgggtactggactggtagaacccactgagcagggagttgttgcaatgccgatt
cctggctctccaggctctgaggccgtacgtttgggcccttttggtgattctgatgcaggct
gtggacctcaccatggcagtcgtggcctcagagaccatcagaacagctagagcacacctg
aggcacggcctcatcctctccaagtcacttcctgccacagatgctcgggaagtgctgctt
ctctgtgcagcatctcctgccctcctccatctggtgttggaggcatcttagatgttctct
gggacctgaggtctgtaggaaaccccggctgtggacttcacacaagggtcgctcttccc
acactccaggtttccctttaagctgctaatttgtaacaggcattcatagaaacagaataa
gatagagaaattctattaaaggaacttatgtgcttttgctctgtctgttgctccatttat
ttgcaatttatagcctaatccaagaggatttaaggacaattaaatatttctttcccctca
gtgtgtgtgtgcgagtgcacgtgtaagagtgtgtaggggttgggtcttccaatgtacctt
tgccctggtttgaccgtggggggagaggtgggcaggtctccaggcctgccagatgtaga
cctttcctaatgtctacagcaaatttgttcttcagtgtttt TABLE 5-continued >IGR2066a
ccaagaggatttaaggacaattaaatatttctttcccctcagtgtgtgtgtgcgagtgca
cgtgtaagagtgtgtagggggttgggtcttccaatgtacctttgccctggtttgaccgtgg
ggggagagggtgggcaggtctccaggcctgccagatgtagacctttcctaatgtctacag
caaatttgttcttcagtgtttctagtatcagttttttgatcaatcattaatcaaagttgca
ataaaaagataatcttctcaggactaggctataaaggtcctggctgcaaccttaaaaaac
ccttctgtggaggcctcagagccaagagaaaaggggcgatgtgtctgtggctggatttgga
ggtaaatgaacgtgctgtccctctctaattggtgtgcacgaacatgaacttcagtcactt
gcgtggctatgcctctttcttcatctctccctgccaacgaagctggtggtgccctggct
cccaagccaggtggcaaagctggggaaggaggctgtagttgggcccaaatatgggggtct
gggggcacctccacaggttgtgaccactgcagcatgctctggggccaggcctatggcagt
ggaggcaggacagccccccaggaccacagagcccccatagtggagggagccactacttggg
cggctcagctcattcctgctgacttgctgctgtacagggc >IGR2067a
ctggggaaggaggctgtagttgggcccaaatatgggggtctgggggcacctccacaggtt
gtgaccactgcagcatgctctggggccaggcctatggcagtggaggcaggacagccccca
ggaccacagagcccccatagtggagggagccactacttgggcggctcagctcattcctgc
tgacttgctgctgtacagggcagaggggtgcctgagacaaagaggagacacacttctccc
acgagaaataaagcaagcagctgttcctctcttgggcccagcaggggtcagaggctgtgg
gaccttcactccttccctctcagtggagagggcagatctgctctttggggtgtgagggca
cagcctcctgacaagctggagaagcaggatttaagagctagaatcaacggagaatgtgag
gcccagcatcaggttcaagaagcaaggggatcaaggttgggggggaggcagggagcctga
gcctagcgcagcccagaccaacagactgaggagtccagagagccaacatgctcactcggc
catcgctaagatgtgtagtgtgtgagaaggtgtgagaggtactcgcgtttctctctccaa
cccccttccaacatattattgggtcgtgggtgccatgttttttagtagacacataaaataaa
tgagtattttcagagaagtgcaaccctggaggtgcagggg >IGR2068a
aacagactgaggagtccagagagccaacatgctcactcggccatcgctaagatgtgtagt
gtgtgagaaggtgtgagaggtactcgcgtttctctctccaaccccttccaacatattatt
gggtcgtgggtgccatgttttttagtagacacataaaataaatgagtattttcagagaagt
gcaaccctggaggtgcaggggagtgaactcagccatgagaaatcattcaaaggattgacc
tatggaacagggatagacttgctctccatggctccagcagggaagcagcagagagggggaa
cctttcctgaaagtccagtgtgacatctgaagacacacacacacacacacactttttt
gagagagagaacgagaatgaaaagatacacactgatctttcaacagtcgttgtctctacc
tggtgattgcgaatgattttaattttttttcctcttgtgcttacagtattttctaaaatct
ctaaaatacacccaaattactttcttgttatggcaaaatagacataaaatgtctacatcc
attttaaccatttttaagtgcagagttccatagtatgaagtacattctcactgttgtgca
gccatcaccaccatccatctccagaacttttttcatcaccctcaacataaactctgcatcc
actaagcagtatctccctgttcttcctccttccagcccct >IGR2069a
ctttcttgttatggcaaaatagacataaaatgtctacatccattttaaccatttttaagt
gcagagttccatagtatgaagtacattctcactgttgtgcagccatcaccaccatccatc
tccagaacttttttcatcaccctcaacataaactctgcatccactaagcagtatctccctg
ttcttcctccttccagcccctggcaaccatccttctactttctgtctctatgaatttcac
tattctaggtacctcatataagtgggatcatctggtattttttccttctgtgtctggctta
tttcacttagcataatgttttttaaggttcatctatgttataacatgtaccagaatttcat
tccttttttaaagctgaattatgttccattgtacgtattcaccatatttttgtttatccact
cctcttgtcatggacatctgggttgtttccacctttttggctattgtgaataatactgcta
caaacactggtgtacaaatatcactttgagtccctgctttcaattcttttgggtatattc
ctagaagtggaactgcgggatcatatgataactaagttttttgaggaaccaccacattgtt
ttcaacaaaggctgcatgattttacgttcccaatagcaatgcacaagggtatctatttct
tcacatccttgccaacacttattttcaggttgttttttgtt >IGR2070a
atcactttgagtccctgctttcaattcttttgggtatattcctagaagtggaactgcggg
atcatatgataactaagttttttgaggaaccaccacattgttttcaacaaaggctgcatga
ttttacgttcccaatagcaatgcacaagggtatctatttcttcacatccttgccaacact
tattttcaggttgttttgttgttttaaaatagccatcctaacagatgtgaagtggtatc
ttacttattatggttttcatttgcatttccctaatctaaattacgttttaaaatccaatc
ctctctgaattgaacccttgttctttattctcaataaaatggaccttgccccctttt
ttccttctttgtacctatgctctgcatttttaaaaaattgtggcaaaatacatataactta
aaactttaccatcttaaccattttcaagtgtagagttcagtattaagtatattcacattg
ttgtgccctaacccaaatatagtatataatggcaaaaagaaacaaaaggctctctaaaga
aaaagaaagccgtgaattcttggaccccagagatgttcacaaacagattggatcaatgctc
agcagggactttcattcatcttctgagcatctctgctgggctgggctctgtgccaggcag
ggggctccgaggtgagtgtggcctggactctgcccttggg >IGR2071a
tagtatataatggcaaaaagaaacaaaaggctctctaaagaaaaagaaagccgtgaattc
ttggaccccagagatgttcacaaacagattggatcaatctcagcagggactttcattcat
cttctgagcatctctgctgggctgggctctgtgccaggcagggggctccgaggtgagtgt
ggcctggactctgcccttgggttcagcctctgtggggaacagttataccccaaggctgc
tgtgggcacagagggacacctgttgtgtgggtgcggcattgggaagggcataagtgag
gtggcacatgagttcaggtgggaaggatgagcagacatgtacatgtgcagagaagggaac
tggcatgtgtggctgggctgtggcagcacacctcacaaccgccattacaggagcatctat
taatcatttatgtctgtctctctacttgattataagctgcatgagagcagggctggtggt TABLE 5-continued tttgttcactgctgcattgctgccatgcccagcacaggcaagtgtaaaagaaacacttgc
tgaataaatgagtggttgatgacgaggaaaaaggagacatttctttccagaatcttggct
gtaagcagcagacagcatggctgtactccacggggaaggcaggatggcaggaagcattat
acaggtgatggagacaggagcacagcaggagccagtggag >IGR2072a
ctgccatgcccagcacaggcaagtgtaaaagaaacacttgctgaataaatgagtggttga
tgacgaggaaaaaggagacatttctttccagaatcttggctgtaagcagcagacagcatg
gctgtactccacggggaaggcaggatggcaggaagcattatacaggtgatggagacagga
gcacagcaggagccagtggagaagaagagtttgaagattccctggttgagagaatggaag
ggcgtaattgctggggagaggtccctgaagaaaggggagaggctgggatgcaggctcagt
ggaaggagaggagtctccttatgagactcagatggccagtgtgaaaaagacagaagatac
caactgctggtaagaatggggaagcacactgcatgggaactctcctatactgctggaggc
gtgttcttcctgttattctagattcagacagcactctggtcgctggttggtgcaggccac
catttgggccaattagaggaacccaatatctgcacttggactatcagaaatgagagctc
tacgcccagagcaatttccaagatgggcctgaatccatgagtcatggcactaaatggagc
caggggttggctctgagcctaacagcctccaaaatgtcaactttgttcacgtgccacttt
gtccctcatctcatgccatgcagctggcaggacttcagtt >IGR2073a
aaccccaatatctgcacttggactatcagaaatgagagctctacgcccagagcaatttcc
aagatgggcctgaatccatgagtcatggcactaaatggagcccaggggttggctctgagcc
taacagcctccaaaatgtcaactttgttcacgtgccactttgtccctcatctcatgccat
gcagctggcaggacttcagttgacagaaggtagaccctgctcttttcaaaaagcacacag
gacaggtgctgataggccagcccctcccactgagctctagttactgcggtgaacttcacc
aggaggttcagcacccactgtggctctgcctgagggcctctgtgcacactcagtccagg
cactagcatcccagcgcccggccagtggtccaactccagactcactacacagagcccctt
gcaaccgatgtgtgccaacatggagcccacacagggcagctcagcgtgacacctgcacag
ctcaagactgagggaaggaaatgcatcttctttctcaagttggaagaggctgtactgaat
taccaaatggcattatactctctgtggggagcacagatgagtgtccggcagtccctggg
atgatgttacagtccagaggtggggatgagatgagcccagatgatgcaatgggatgcaa
tcaagacacgatgtcattagaagccacagtgtgttctctc >IGR2074a
aatgcatcttctttctcaagttggaagaggctgtactgaattaccaaatggcattatact
ctctgtggggagcacagatgagtgtccggcagtccctgggatgatgttacagtccagag
gtggggatgagatgagcccagatgatgcaatgggatgcaatcaagacacgatgtcatta
gaagccacagtgtgttctctcatgccacgtgtttcccagcttagaggagtaaggggtcaa
ggaggggggggtggccccctgggaccctgctctaggacgcatgcataaggacccacatg
caaacgcacagaattcaagagctagccaggcctggacccatgtaggagagccccactggc
tgatttccaatctgggacaaaggccacagacaggaggcctcccttggccacacccaggtc
cccagaacatatgctccactgtcccccagtctaaccacaaccccatatgagctgtgtccca
ttcatgttggcctagaaactgggaagtacctggcatggggccctccgcttcctccccatg
actgcctggagctctggggagaccaccaaggggccattttttgtggttaggaaatgtctgt
ggcagctgtggacaccacaggccctccctggacccttctgaagtagaggtcacattccta
aagattcttaactgccagctccaattgcttcttcctgaca >IGR2075a
tgggaagtacctggcatggggccctccgcttcctccccatgactgcctggagctctgggg
agaccaccaaggggccattttttgtggttaggaaatgtctgtggcagctgtggacaccaca
ggccctccctggacccttctgaagtagaggtcacattcctaaagattcttaactgccagc
tccaattgcttcttcctgacaggctcatcttagtagggagtgaatataatctttttcccag
ttccacgaggtcctctcagatccaaaatgctctaagttcaaaggcaaatcatgaagaaag
ggagacgcagatactaatttgtggttttagttcagtggttttccaccttggctacacagt
agagttacctaaggagcttttttaaaaatactcatgtccaaatattccaacaggcactttg
caaagagaagatctaaatggctaacaaacatatgaaaggttgctcagctgtatagtcat
cagggaaatgcaaattcaaccacactgtgataccactacatacctgccagaatggctaa
catgaaaaagatagaaaatatctatggttggcaaaaatgtgaagcaaccagaactctcat
acattgctggagggagtgtaaatgggtacagccacctgggaacattatttggcataaggt
actaaagctgaacatactcatatccatgcttccccagcaa >IGR2076a
accacactgtgataccactacatacctgccagaatggctaacatgaaaaagatagaaaat
atctatggttggcaaaaatgtgaagcaaccagaactctcatacattgctggagggagtgt
aaatgggtacagccacctgggaacattatttggcataaggtactaaagctgaacatactc
atatccatgcttccccagcaatggatatacatgtactccaaaaatacacactagcatgtc
attgcaatagtcagaatagttccgaattataaataacaactcgaatatccaaaaatgcat
cacagtagaatggataaatcgaggaatatccatagagtggaatactctatagcaagaaga
gtgaataaactgcagctctaagtaacaacttggatgaatcatctcacaaacacaacaaga
ggatatatactgcctgattccatttacatcatataaagtttgaaaacaggagaaatgact
gtacaccattagaagccagaatggacattagcctttggagccaggtagtaagtggaaggg
gtaccagggggttgctggtgatgttctgtttcatgatttggatgctggttactcggggtaa
attcattttgtgaaattcactgagctttacacttatggtttgtgcttttttttttttttttt
tgcatatatgtcatccttcaacaaacacttaaaaaatgtt >IGR2077a
aatggacattagcctttggagccaggtagtaagtggaaggggtaccagggggttgctggtg
atgttctgtttcatgatttggatgctggttactcggggtaaattcattttgtgaaaattc
actgagctttacacttatggtttgtgcttttttttttttttttgcatatatgtcatccttc TABLE 5-continued aacaaacacttaaaaaatgtttgaaaaccccatcaattcagtcagactctttgggtggga
gcaagatccaggcatcagtattttttaatatcccagatgatggtaatatgcagccaggat
ttaaagtcactggtttaatatcttgggaaaagcagatccactcaagacctcacagggtcc
tgacaaaggccacttccagctcagtggagtgagacactgggtgggaagatgtccattt
ttggatgtgggtcagtctcttgcacaggcagaggtattgcagcatgctgttgtaatgtgt
atcttccttggcagtgtctgttgaaagctggttgcatcagtttgtaatgggtgtaatgg
caacaaggtgggcccagcccccccaggaagtggatcactgagcacagcttctacagggc
catttgtagagaggtggcagctgggcttcccaggggctgccacccagggcagagccagtg
ctgaggctctgacaacctcggcagggtggggagaaggcca >IGR2078a
gttgaaagctggttgcatcagtttgtaatgggtgtaatggcaacaaggtgggcccagcc
ccccccaggaagtggatcactgagcacagcttctacagggccatttgtagagaggtggca
gctgggcttcccaggggctgccacccagggcagagccagtgctgaggctctgacaacctc
ggcagggtggggagaaggccagactcagggtgtttatgtttgtgggtaatgacagtcagc
tctgggctccagatgatgcttactccctggcctctgttgtcagattaggaacttgcaaca
tcttgctgaggaccatgtcaggctcagctctaagtgctgtggctgagaattttccttcct
ctctgtgtggttagtggcagcctcctagcaatgctgacctctagcatactctgtcaaa
ctacaggcagctgggacaagacaggacatgggctcacagacaggtattccacaacctgg
gccctgtcaaccctcccagaaatgcatgggccatgaacctcctgctgtgggaggggcagt
gcagagaagtctcaataagcttctcttggccctctgggatctccaccatccacagtgtgt
agggctgagctgcaggctgggtcttcaggtggtgtccctgcacatctgctttgcagcgtg
gcgtctatagagcaagagtgaacaggaaggggcctcgggc >IGR2079a
aaatgcatgggccatgaacctcctgctgtgggaggggcagtgcagagaagtctcaataag
cttctcttggccctctgggatctccaccatccacagtgtgtagggctgagctgcaggctg
ggtcttcaggtggtgtccctgcacatctgctttgcagcgtggcgtctatagagcaagagt
gaacaggaaggggcctcgggcctcctgtagctctgctgggcagggacgctgcggggcctc
agctgggcttccttggctaaagggcacagagtggcgtaggctgcaagaggacaagctaag
ctgatgaaggctctatcactcaagggtagccatgtaaaaaaaaatccctacaggtaaaag
aagcatgaataagacaggcggggcataacagtgtctccccactgaagctgcaactctctg
cttcactggcttcagcctcctctctgtgaaatggggcaatgtccctaggccttttcct
cctgtccagtagggctgagggtctacaggccagagggaggcctgggctctgaggcctgtg
cctgtgtggcctctggctgggacctcagcccccatgtgccatgtcacctcccttgtctgt
gaaataccacaacagcagctcttgccagccagtgacactaccccttcctgttgtcttctt
tacaaagcatttatgaaatgcttccttttcatgcttcagg >IGR2080a
ggtctacaggccagagggaggcctgggctctgaggcctgtgcctgtgtggcctctggctg
ggacctcagcccccatgtgccatgtcacctcccttgtctgtgaaataccacaacagcagc
tcttgccagccagtgacactaccccttcctgttgtcttctttacaaagcatttatgaaat
gcttccttttcatgcttcaggaaaccggtggccaggaggagttcttgatttcattttctt
ccctagagatatgtgtgcttcgaaatacacaaattaaacaaaaacgagggctgactggga
ccaggagagtgagtgatcctggcttcccttgatttacatgcttattttccttctcaaatc
actccagtaagtacagaagtcactaatctattgccctctattatctgcattatagttaaa
aacatcgacatgaacaaacaaaagcccttgcgtagcctagagaagtcacaaagctcacac
ccagactctcgcctaagagagtctctcagggctcactcagggactatttattcttgttttt
atttttttaaatgttgatacccctctctgcttgagtatccttgttttagatgcaaatcaga
aaaggttgctgtattgatcacagtcccagcaggaaacaaatgcacactccactggtaaca
ggagagactgaggaaaggaccgtttccaagggtgagcaag >IGR2081a
agtctctcagggctcactcagggactatttattcttgttttatttttttaaatgttgata
ccctctctgcttgagtatccttgttttagatgcaaatcagaaaaggttgctgtattgatc
acagtcccagcaggaaacaaatgcacactccactggtaacaggagagactgaggaaagga
ccgtttccaagggtgagcaagatgaagagaaaccctcaaggaaaggtgaagcatcctgca
gccagcaacagtgggagctgtgaccaccaatcccagggagggaggtgggagggctcctgg
aacccagagagacctgtaggagggggactgccggcaggagctgtggttttagggtgaaaaa
cacaggcactattgacctgagacctggcaagggagggagctgggggggataaagcacctcc
catttcccctcccagcctccaacctctggtcaggggaggggtcttcaattggccaaaccc
aactggaagcttgggacctggagcctggctgatggaatccacaaagtcaaatcctggg
aggagtgggaaagagcagaaaatcaactggagcagggatgtgtgggggggtggcaaacaa
acaatgcccggcagagtcaccagggctggccatttgaaaagagtacatcagaagctaacg
tgctgtaatgtggcactctcaccacaaatacataggatga >IGR2082a
tggagcctggctgatggaatccacaaaggtcaaatcctgggaggagtgggaaagagcaga
aaatcaactggagcagggatgtgtgggggggtggcaaacaaacaatgcccggcagagtca
ccagggctggccatttgaaaagagtacatcagaagctaacgtgctgtaatgtggcactct
caccacaaatacataggatgaaaaggcagccagggacagaggcggccacgaagaaaggttt
aaagaatcccagcaaaatgactggggtcctccattatggaagaacaaatagctttacttaa
taattccaaggtaatagcttaatagcttaataattccaaggtaaacaagtattttcataa
ggaggactctgaatgatcaacagaaggttaaatgtcactgtactgcttcacagagctgtt
acagggcagggagactataacaatgtagagatagatccatacaagaggtacaaca
gggtttccagttcaacacatcagttatttacactcctagtttcctttctctcctgaagca
ccactaaaatgctagtctagaaatcaaatggggcaggtgcagtggctcacgcctataat
tccagcactttggtaggccaaggcaggaggatcattgagtccagaagttcaagaccagc
ctgggcaacatagcaagaccctgtcttaaaaaaaaaattg TABLE 5-continued >IGR2083a
tcagttatttacactcctagtttcctttctctcctgaagcaccactaaaatgctagtcta
gaaatcaaatggggccaggtgcagtggctcacgcctataattccagcactttggtaggcc
aaggcaggaggatcattagagtccagaagttcaagaccagcctgggcaacatagcaagac
cctgtcttaaaaaaaaattggctgggtgtggtggtgtgtacctggagtctcagctactc
aggaggctgaggtggaggatcacttgagcccaggagtttgaggctgcagtgagctatgg
tcacaccactgtactccagtctgggcgatgaagtgatacccgtctgtctcttaaaaaaatcaa
atggggccaggcgcggtggctcatgcctgtaatcccagcactttaggaggatgaggaggg
tggattacttgagatcagaagttcgagaccagcttggccaacatggtgaaacccgactc
tactaaaaatacgaaaagtagtcaggcatggtggcacatgcctgtagtcccaggtactcg
ggaggctgagatatgagaattgcttgaacccgggaggcagaggttgcaatgagccaagat
tgtgccactgcactccagcttgggtgacaaggcgagactctgtctcaaacaaccaaccaa
ccaaccaaatggtattaactctcaaaggcaaagagaatgg >IGR2084a
agtcaggcatggtggcacatgcctgtagtcccaggtactcgggaggctgagatatgagaa
ttgcttgaacccgggaggcagaggttgcaatgagccaagattgtgccactgcactccagc
ttgggtgacaaggcgagactctgtctcaaacaaccaaccaaccaaccaaatggtattaac
tctcaaaggcaaagagaatggtaaaggagacatgagtggctgaaagagttccccaaacta
caggaagctgggaggcaggtggaggaataatgactgacatggagaagctaggctctgaa
gggcttgcagaggggcacactgacaggaggcaagccactttaccccctggaaccctgcagg
aggagctcagacttggggagtccaggtgttgtggctggtggggctgaggtacagcagcca
gtgggggtaatgaatggaggaaactggttgaaatcctcccaggtctcacctccacaccc
tgccccacacagctggagacaaagacactgaacaggagagagacaggcaggagggagggc
agatgaatacagggatgaaaacagggaggtgagggaaaagtctgaagaatgaagcgtggg
actcaatgtcccacccacttaccttgccccgccccacccccaggtatatatcactctggat
gagggtatggtgaatttaaaagatggttgcaaattcttttg >IGR2085a
caaagacactgaacaggagagagacaggcaggagggagggcagatgaatacagggatgaa
aacagggaggtgagggaaaagtctgaagaatgaagcgtgggactcaatgtcccacccact
taccttgccccgccccacccccaggtatatatcactctggatgagggtatggtgaatttaa
aagatggttgcaaattcttttgacatttctccaatggagaggtgggtctgtgtctccttcc
ttgaacctatgtggatttctgactacagtggaaatgagctatgtgacttccaaggctggg
acatacacagccatgcagcttctgtcttgctggcagaacactcacaccagagacttgag
gtgcctcgtaagaggtccaatgaccaggccatggtgctggagacatcatgtgtagtctct
ctggtcaacagtcccaactgagcccagccttccagctctctttgccaagtgaacaaccat
cttacaagtggaccctttcagcccagctgttccaactcccagttattccagtcacctcga
gtcattccagtcatcctagccgtcgtagagcagagaattgcccttctgactccttgacag
tggcccaaaaaatggttgttgttttatgctactaagttttgaggtggtttgttatgtagc
gttcaataactagaactaggagttagaatgcttctcttga >IGR2086a
gccccagctgttccaactcccagttattccagtcacctcgagtcattccagtcatcctag
ccgtcgtagagcagagaattgcccttctgactccttgacagtggcccaaaaaatggttgt
tgttttatgctactaagttttgaggtggtttgttatgtagcgttcaataactagaactag
gagttagaatgcttctcttgaggagctgaatggcttcaggtggtggttctcaacagggt
gattttgtcccccaggggacatttggcaatgtttacagacattttggttatcacaactct
gggaggggggttactactggcatttagtaggcagaagtcactggtgctgctaaacattct
acaatgcatgagacagcctctgacaacaaggaattctttggcccaacatgtcactagtac
caaggttaagaaacctagctctagagaaaggtgctcattggaggcttgttaactaaaag
actgtcttgcttcctgtagtgaaaccccagttgataaattctccccaagcagagtttagt
tcagccttttattgctccattaataaataccaacagatagctgagatatttggcatttaa
ggaaagcctccaacaaggagagatggagagacagagagagggagaagaaaaagaaagcag
aaggaaaaaggaagaaggattaaagaagagggaagaagaa >IGR2087a
tgaaacccagttgataaattctccccaagcagagtttagttcagccttttattgctcca
ttaataaataccaacagatagctgagatatttggcatttaaggaaagcctccaacaagga
gagatggagagacagagagagggagaagaaaaagaaagcagaaggaaaaaggaagaagga
ttaaagaagagggaagaagaagaacaagaggaagaggaggaggaagaagaagaagaagaa
gaaggatgacgacaacgacaacaacaacaacaacaagaagcagccaccaccgccgctgcc
acctccaggtagaaacaaaaacaaaatagagactagaagactattaagacaaatggacaa
atgaaaaataaatagtgcctcaagaagaataggatggagatagtatatgcataaaaagaa
atgtggtattttgaaaaagaacaggaagaacaaagaatgagtactaggatattagaaaaa
gaaagccaaaattaaaaaaaaaaatcaacagaagggttggagtatgaagtcaatgaaggt
ttcccaagaaagtagaccaaaaggcaaagagatgaaaagtaggagagaaaatataagga
aactaaaacattaatccagatgatccaacagataaaatacagggaagaaaattattaaag
aaataatacaagaaaatcttccaggactcaaagatgctac >IGR2088a
aaaaatcaacagaagggttggagtatgaagtcaatgaaggtttcccaagaaagtagacca
aaaaggcaaagagatgaaaagtaggagagaaaatataaggaaactaaaacattaatccag
atgatccaacagataaaatacagggaagaaaattattaaagaaataatacaagaaaatct
tccaggactcaaagatgctacataactcagcagtgacgaatatgtccacattcactattg
agttaaccacagattgtgttatgttcctattggaaggatggagaggaaaagtgggggat
ggttctgtaggaaagttcaatcctcatctatcacaagaagtcaacaaatgcctaaaatcg
gtagatcaaaaaatagtataaacagaaatggaaactagtaaatggttgaaagaggcagcc TABLE 5-continued tatagagaggggggagtgagaaaggcggggaagggattttttattatgggcttctcagtaca
actgatatttaaaccatatgcatgcattattttttattttgttttaatggatacataat
aattgtagatatttatgcagtgcagtgtgatgtttccagacatacatatagcatgacatg
atcaaatcagggtaattagcatatctatcaccttaaacacttgtcatttctttgtggtga
caacattcaaaatcatctcttccagctattttgaatttgt >IGR2089a
gcatgcattattttttattttgttttaatggatacataataattgtagatatttatgca
gtgcagtgtgatgtttccagacatacatatagcatgacatgatcaaatcagggtaattag
catatctatcaccttaaacacttgtcatttctttgtggtgacaacattcaaaatcatctc
ttccagctattttgaatttgtgcattattttgataaatttgatagaatagaaattaattt
aaaagggtacaattttaaaactgcaatgtgatgggatcaaatttaataatttggaaaatt
cgcttatgtagaagagtcatgcctctctaagaatgctcaatgaactggcataggtgggca
caagcaccatcagcatggaagggttcctcctgatgtcactggccactaaggcagttggtg
gggtgagggtggggatgagagccaggcatggcagcccttaggtggtcaccatttccctct
cctggcagcctgtatttgcttgggagacctatctcttgggtatagatcctattgggctgc
taaagaagagaggtgctaatccttttaggatgacttctgggaattcaccaggatgccctg
cctctcctactctggacatggaaaaaaatgctgggtttaccaaaggtggatgagtcaggc
ccaggactagagccacggggcctctccctggacgtgccat >IGR2090a
ttgggagacctatctcttgggtatagatcctattgggctgctaaagaagagaggtgctaa
tccttttaggatgacttctgggaattcaccaggatgccctgcctctcctactctggacat
ggaaaaaaatgctgggtttaccaaaggtggatgagtcaggcccaggactagagccacggg
gcctctccctggacgtgccatagtcaggctgtctcggcagctaaaagaggctacacacat
ttattgtcatcagaagctgggacagatgagccttgggttacaagatctcctacctggagc
tctcccgggaggtgccaatcataggggatggggaggacaaacacatgcttggtggggctcc
agcgttaccgccgaggtgcatctccttggccactagccctgggtctgacctcccctct
cttttccttcacccattgttctccctattcccttctttcccacctctctctcagttctc
cagagctctgtgcagggactacttagcaaacttacctgctgaaatgcactgtttttttt
ttaaccttttaaattgtcactttttttaaactataccatccttagataagcaggagata
ttccttgtagaaaaataagaaaatattaataatcacccatgattctatcagtcagaaaac
tccactgctggtgtatgaatttccagaatgtttccaggct >IGR2091a
tacttagcaaacttacctgctgaaatgcactgtttttttttttaaccttttaaattgtca
cttttttttaaactataccatccttagataagcaggagatattccttgtagaaaaataag
aaaatattaataatcacccatgattctatcagtcagaaaactccactgctggtgtatgaa
tttccagaatgtttccaggcttataaacgggtaaaaatactatcacagtccatgtctcat
ctaagcacccagctactgagcaatcatcacctactgggctgtgctgaggcctttagatgt
gttaatctctcttaatccttccaacttcacaagataggtgttattgtgccccgtttacag
gcaggaaacaagttcagggagatcacattaattgcctgagttcccaagttggttaagaga
ctaagctagatctcaacccttcaggctgaatccaaagctactttccttgaatggtttgta
agattttccatttcttttttaaaaaaatggtatgttcaaatatctttctcatcaataaa
tatttatcttcatcattcttcctaatgacattcccttgtatgaatgtgccaatgtggaat
aaccagttccgtcttgttgggctttcagatgttttcttttttgtaaatgataaacaatgca
gttataactatctttatatataaactttgcaatagtatga >IGR2092a
ttaaaaaaatggtatgttcaaatatctttctcatcaataaatatttatcttcatcattct
tcctaatgacattcccttgtatgaatgtgccaatgtggaataaccagttccgtcttgttg
ggctttcagatgttttcttttgtaaatgataaacaatgcagttataactatctttatat
ataaactttgcaatagtatgagtatttcctagaataaatactggaaagtgaaattgcgt
ggtcaaaggccagacacattttaaaagctgcctctttcccaatcacacatttcccacat
ccatttatttgctgaggatcttcacaaaatttggactgagattaaacacagaatcagaga
agccctatgctggaaagatcttagtatatacctcttgaactaaaccagtcttactttaga
aaaaaaaaaaaaaaggccaggcgcggtggctcatgcctgtaatcccagcactttgggag
gccgaggtgggcggatcatgaggtcaagagattgagaccatcctggccaacatggtgaaa
ccccatctctattacaaatacaaaaattggctgggcgtggtggcgtgtgcctgtagtccc
agctactgggaggctgaggcggaagaatcgcttgaacccgggaggcagaggttgcactg
agccgagattgtgccactgcgcttcagtctggcgacagag >IGR2093a
gaggtcaagagattgagaccatcctggccaacatggtgaaacccatctctattacaaat
acaaaaattggctgggcgtggtggcgtgtgcctgtagtcccagctacttgggaggctgag
gcggaagaatcgcttgaacccgggaggcagaggttgcactgagccgagattgtgccactg
cgcttcagtctggcgacagagactccatctcagaaaaaaaaaaagccctagaccc
tctgcagcagcctgctgtgccttcagtgggccaggcagcacttctgggcaagtgaggaaa
gggagacccggagggaggtagggaagtgagggcaagagggccatgctgtgggcccacaac
caactggcttggggaggctgctacattttcccaagtgcaacactgtcttcctgagtcta
aagacctcacagccatcactgactatactgagctgcctcactgtccccaggactctcact
ctatccaggaagtcaacgcaaagtctcttgggccttcccttatccagctgccaacactt
agcaccctggtcttccttggacagtttccaaggctacgttgggcagtcccaaacaagatg
tggtcttattgttgtcttaccttggtgtgttttcctccaataggctacaaactctggcac
ctgcaaaaacaaggaaagtaaatgattgaagcagggcac >IGR2094a
aaagtctcttgggccttcccttatccagctgccaacacttagcaccctggtcttccttg
gacagtttccaaggctacgttgggcagtcccaaacaagatgtggtcttattgttgtctta TABLE 5-continued ccttggtgtgttttcctccaataggctacaaactctggcacctgcaaaaaacaaggaaag
taaatgattgaagcagggcactgaaggtgggcctttgaacaacgcaagcctggatggaag
ttgaaagatgagagcccatctgtggtgagttcttttgaaagctgctgaggtgtgagttggt
aggatgctggcccagggcagacacgggcacaagcttccacccagcggcattctccactca
gagggtttctttctcatttggcctgttaatgctcctatactggcagaaacctcagtgccc
ttcccactttgtctcaaggccttgtataaaaaataagttgtcccttcattcatttccatg
gatatatccattcatcagctatttactgagcacctactatatgccaggcactgtcctagg
gctctgggaatagagcattggactaaaaaggctaacaccctgccctcatggagcttgaag
tctactgggtaggggggtggggcggtggtggtagtgaagagtccaaaaactaacaagata
cataaattaaaaatataggaatcagaagtggtaaatccta >IGR2095a
tatttactgagcacctactatatgccaggcactgtcctagggctctgggaatagagcatt
ggactaaaaaggctaacaccctgccctcatggagcttgaagtctactgggtaggggggtg
gggcggtggtggtagtgaagagtccaaaaactaacaagatacataaattaaaaatatagg
aatcagaagtggtaaatcctagggaggaaaaaataaggcaggagagaggtaaggaata
ttggggcagaaggtgagaaggcgtgtaaaaattctaaaatgtgtgtccagagaaggctag
acacctgagaaggtaaattatgaacaaagttacctgaaaaaagtgaggacatgagccctg
agaattaacggggaagaagcttcccaggtggagggaatggcaagtgcaacagcctggcag
cgagggcctgtctgacatgttaacagataagtgaggaggtggtgtagccagagtagaga
gaataagggagaagcaggagagggatcagagaggtagcgagggctccacagtgttcacg
gcattcaagggaggtccttgtgtgaacttgggctctgattctgagacaggagccactaga
gggttttttacagagaagtgacatgatgtaactcacattttaacaggatcactctggatg
ctgtgttgagaataaactgagagaaagagtagaaccagtt >IGR2096a
gagggatcagagaggtagcgagaggctccacagtgttcacggcattcaagggaggtcctt
gtgtgaacttgggctctgattctgagacaggagccactagagggttttttacagagaagt
gacatgatgtaactcacattttaacaggatcactctggatgctgtgttgagaataaactg
agagaaagagtagaaccagttaggaggctatggcagaaatcttggcaagagacaatggtg
gcttggaccagagcagtagcatggaggatttgctgatggattggaagtgagagattaaaa
agaatgggtttagaacctgactggggcaggttaaaagaaaggagctgaagctgtgaact
aggagacagagttggctgggagcagcaggaagattcccagttttggcctgagcaactggg
aggatgaattgccattttctgaatggaagcgtacagatggagcatgttttgtggggaga
taaggaatacggttttggacgtaagtgtgagatgccttttaagcacttaagtggagaaga
ctgtaggcaggtggaactgtgaatctggggagaggtccaggctggaaatgagtatttgtg
agttctcagcacatagttctttaaagctgtgacacaggatgagatcatcaagagggtgga
tgtcaatagggaagctgtcggccgggtgcggtggctcacg >IGR2097a
cgtaagtgtgagatgccttttaagcacttaagtggagaagactgtaggcaggtggaactg
tgaatctggggagaggtccaggctggaaatgagtatttgtgagttctcagcacatagttc
tttaaagctgtgacacaggatgagatcatcaagagggtggatgtcaatagggaagctgtc
ggccgggtgcggtggctcacgcctgtaatcccagcactttgggaggccaaggcgggtgga
tcacctgaggtcaggagttcgagaccagcctggccaacctggtgaaaccccgtctctact
aaaaatacaaaaattagctgggtggtggtggcaggtgcctgtaaccccagatactcaggag
gatgaagcaggagaatcacttgaacccaggaagcagaggttgcagtgagcggagattgtg
ccattgtactccagcctgggtgacagagcaagactctgtctcaaaaaaaaaaaaaaaaaa
agaaaagaaaagaaaagaaaagaaaaaaaaaaaccagggaagctgtgcaaggggctgagc
cccattcagtagctcagcaaaagagactgaaaaggactagcaagtacagtaggagggaaa
cctggagaaagacttctgaggaggatggcatagtccactgtgatagatcaactatttaat
aatatgaagacagagatttagcatcttggagtcacaggtg >IGR2098a
aagaaaaaaaaaaaccagggaagctgtgcaaggggctgagccccattcagtagctcagca
aaagagactgaaaaggactagcaagtacagtaggagggaaacctggagaaagacttctga
ggaggatggcatagtccactgtgatagatcaactatttaataatatgaagacagagattt
agcatcttggagtcacaggtgatcctggtcagggatgattcagtggaacagttggagtga
gaatctgactacagcaggttctaaagagaggagctgaatttgggagctgagggatggagt
tggctggtgacagcaggagggctgaagcagagggagagggatctaacctacattggttc
caccttaagagaaaacacaaagctggtacttcctcaacacctgtacgtggccgctgttgt
tactaacactgggccaggtcctccagcttgctgagcaccacccaggtctggtcctataag
ctagctctccacctgtttctagattcctatgaagttatttccttttttctcactgctgtgt
gtagccttaggataaatgcccatagcttggggctgctgagcaagtcctcagttgcttgtt
gaccaagatctggcttggtcctttctcctaatgggaagtcagagtgagcaagggactct
gctcttggatagcttgccttctgtgcaggagataaataat >IGR2099a
tagattcctatgaagttatttccttttttctcactgctgtgtgtagccttaggataaatgc
ccatagcttggggctgctgagcaagtcctcagttgcttgttgaccaagatctggcttggg
tcctttctcctaatgggaagtcagagtgagcaagggactctgctcttggatagcttgcct
tctgtgcaggagataaataatcaccaaggaaatggatatgcaggcaggtaacttcagatg
cagatgggtgctatgaagacagtaagctggggtgaaacacacagagtaagtgtgggagcg
acctcctttcgccagctgtgtggtcaggtgcctctctgggaggtgacatttaggatgac
acctagacagcgatgcccagcttattctcctcaagctggcctctcctctgctgctcccag
ccttccccgtggcttctacaatatctgcactctgggaacaaggccaaggccttgggccat
ctaagtgcaaagccaaaaggaaacaatcctcttctctcgccaatacacaccatgggaact TABLE 5-continued ttttctccatgattacaaaatacgtgcattttcactgaaggaaacttggaaatattgaaa
acaggagaaaacgtgtcattctactacccagaaataactacaattaactttggatgcatc
cttctagacattcttctatgcatatatataggtattttttt >IGR2100a
gaaacaatcctcttctctcgccaatacacaccatgggaacttttttctccatgattacaaa
atacgtgcattttcactgaaggaaacttggaaatattgaaaacaggagaaaacgtgtcat
tctactacccagaaataactacaattaactttggatgcatccttctagacattcttctat
gcatatatataggtatttttttttcttatttccttgggttaaaaatgagatcatgtacatt
gtgtttatgatctgaattttgactaaatctgttataaagcactcttctcatgaaattaa
ttttcttctacataatgagtttaaatggctgcattaaaagtatttcattatatgtagatt
tttaccatattttatttaattcctaaacattggccatttacattgtttcctatgattgtt
actaccagcaaatgctctaataaacaatcctgtatattttccttggagaagggggtttg
ccaatctcttatttccttgggttaaaacaaaatgtcactgcccagtggcagtgccatggg
tctcatggcagcctgaggctgagggcatggagggcaggaatgagccccaagcctaagga
gccactcagatgccagaggctgatttagtcctatgacatgccaggtcttgagttttcctc
ccctgagggcctgatcagtacgaaaacaataggcctctcc >IGR2101a
ggttaaaacaaaatgtcactgcccagtggcagtgccatgggtctcatggcagcctgaggc
tgagggcatggagggcaggaatgagccccaagcctaaggagccactcagatgccagagg
ctgatttagtcctatgacatgccaggtcttgagttttcctcccctgagggcctgatcagt
acgaaaacaataggcctctcccataaacccagagaaatccaaggggattccccacctcag
caggaagagggtgtcactctctgaccccagaatagagaccacctccatcctcccttgaaa
tcccctgggaagcttctcctgccctccctccctggggaaaacattggcacggtcaggcc
ttcaatctctctttggggaggggctgccagggaatgctcaggaaacagaaggttccatag
gaatagcagggcctgtcctatccctgacccagccttttccctaaatcctcaaattcccca
cagggggctggcagggacagtctatgctccccgtaagaggatgtcctgagggctagtgagt
tctagggtaaggtgggaggccaccagatgagggtttgaatccaggctctgacattccagc
ctcgtcttgggcaagtgacttcacctgtggaatgtgagctacgaggaaggaacttagatt
tgcggcccttagcattcaacaggggctctataaataccag >IGR2102a
tctatgctccccgtaagaggatgtcctgagggctagtgagttctagggtaaggtgggagg
ccaccagatgagggtttgaatccaggctctgacattccagcctcgtcttgggcaagtgac
ttcacctgtggaatgtgagctacgaggaaggaacttagatttgcggcccttagcattcaa
caggggctctataaataccaggccaggccaatgcatgatcctgtctgagcctcagctgct
catatgtgaaatggatgacacctatctcacaggtttgttgtagggactaaatacaactta
atacagttaacactctactgtttgagaaacattagagtccaaagccctggagggctactt
ccaccacgcccatgctttgtagtctcctcttttttggcagaactagtttacctccacact
gctactaccacaccctagacataccctctggtgtagtatgcagacattgtgtgtgtactt
gtccaactcctccatgaagcttcagggcagttaaagacaagaattttgcctctctatcgt
ctgtgcctctgaatgacactatgaagtaagcaagggcattatttccattctacaaatgag
aaaactgaggcttagaaagattagatgccttgcccaagtcacacagtggagagtaggaga
gcaagacctaaacctggttctcatttctgggcctgtgttc >IGR2103a
cttcagggcagttaaagacaagaattttgcctctctatcgtctgtgcctctgaatgacac
tatgaagtaagcaagggcattatttccattctacaaatgagaaaactgaggcttagaaag
attagatgccttgcccaagtcacacagtggagagtaggagagcaagacctaaacctggtt
ctcatttctgggcctgtgttctgtaaaccaaaaagaaaattccaaggcacccccagctg
tctgaatagaccctcctctcggccaagggcattccaaagttaacctgaaaaactagttt
aggccatgatgggaagggggagccagacatgcctcgttatacctctcctttttggaat
tactgactcttaagactgataagagatatttacagtccattctctctgaagcctgctac
ctggaggcctcatctgcataataaaaccttggtccccatagccccttatcgtaacccaga
cattcctttctgttgctttctattgataataactctttcaaccaattgtcaatcagaaaa
atttttgaatccatctatgacttgaaaccaccccactccccaacctagttgtcctgcct
ttttggacagaaccaatgtacatcttatatgcattgattgatggctatgtctccctaaaa
tgtataaaaccaaattgtggcctgaccactttgggtacat >IGR2104a
ctattgataataactctttcaaccaattgtcaatcagaaaaatttttgaatccatctatg
acttgaaaccaccccactccccaacctagttgtcctgccttttggacagaaccaatgt
acatcttatatgcattgattgatggctatgtctccctaaaatgtataaaaccaaattgtg
gcctgaccactttgggtacatgttctcaggatctcctgagggctgtctcacaggccattg
gttacttatatttggctcagaatagatgtcttcaaatattttacagtttgaccgacaact
ctattctagatgattctcttgcaaagggagttggaggtgagaaggaagtgagccaattc
tcatgtccctgagaaaaggcaggcagagcttcgagaggaaggaggtgcttgggaggca
gcaggacactgcacttgcctcagcccatcctgactccccgtggatcatcgtgcatgcag
cagctgtgaccccagaggcctctagttcagcataagctgaggcaaaggggggcccccagg
ttccctctactggtgtggagcccagccgggcaaggggactcggcggcccagagtt
gattgttgtggcccagcagcaggatgatggctgtagagcacctgctcaggagttggcct
atctccagctatggggcgggaaggctccctaccagaccac >IGR2105a
cctctagttcagcataagctgaggcaaaggggcccccaggttccctctactggtgtgga
gcccagccggcaaggggactgggatcggcggcccagagttgattgttgtggccccagca
gcaggatgatggctgtagagcacctgctcaggagttggcctatctccagctatggggcgg
gaaggctccctaccagaccacacacatcttgatgtactcaccctgtgagcccaggacccc TABLE 5-continued tgtgatacctgctgaggtgaaggctgaatgagtgagagctcccagcctccagcatcaggg
cattagggagaagaagcagctagactcaagccagggatgcagagggagggaacaggcatc
aggtagtaggtgttttaatgtcacctacctcttattatgttgtatgtttctggaggatgg
gtccatggctgatccatccttgtgtctctactacaaccagcagattacttttacagagagt
tgatactcagtaagtacagcttattgaaggtgtaaccaaaagccagtaggcaggatgaca
gatggcatccgccttgcatgtctgggtcatcagggaaagggccaatgtccagtgtgtcct
gaccaggatggtctgacaaggacatccatagcatccacagagggtgctccctccccagg
caacaaactctccctccctcctttctttcttccttcccctt >IGR2106a
cttattgaaggtgtaaccaaaagccagtaggcaggatgacagatggcatccgccttgcat
gtctgggtcatcagggaaagggccaatgtccagtgtgtcctgaccaggatggttctgaca
aggacatccatagcatccacagagggtgctccctccccaggcaacaaactctccctccct
cctttctttcttccttcccttttttttgagatggagtctcacttattgcccaggctggag
tgcagtggcacaatctcggctcattgcaacctcgcctcctgggttcaattgattctctg
gcctcagcctcccgagtaactgggattacaggcatgtaccaccataccggctaattttt
gtattttagtagagataggcttttgccacgttggccaggctggtctcaaactcgtgacc
tcagttgatctgcctgcctgggcctcccaaagtgctgggattacaggcatgagccaccgc
tcccagcacactctcccttcttagccaaagagacaccacttggaggaaactacctggat
ctaggtgcttccctagtgacaaaaatggactggggatgtggtataaatccttgcccctgg
gaatctggaagggacctatgatatgagaaaaacaaacaaacaaacaaacagaccaatta
tctctttattgagaccaaaactgctgcttttgcctgaatg >IGR2107a
tcttagccaaagagacaccacttggaggaaactacctggatctaggtgcttccctagtga
caaaaatggactggggatgtggtataaatccttgcccctgggaatctggaagggacctat
gatatgagaaaaacaaacaaacaaacaaacagaccaattatctctttattgagaccaaa
actgctgcttttgcctgaatggtcagattgactgattcctcttccacttgccatccccac
tgcatgcatggctacaaataatcctgatgttgcacatttaaaatagtgccttgcttcaac
tgcttcagtctatcagtgtaaactgtgtctccctggcaggtatgctgtgggggacagtg
cagggcttgtctctgtaggaccaaactcagtatgaacttatcacctgcctgtgtgtacag
ctttaagcttcaggtagaggtgttataaaccctggagtaggacttccctagagaacagg
tcattacactatgtccatctattgaggccctaaattaagtctacagaattaggcctaaac
tccgcagacagtagccaaaggtctcaggctctggcccactccacctgtccatccacacct
ccttctcatcttgcccttcactcacttaacacagtgcccaaagggagatgcagttgcctg
gacaggctggctttggcttaagctaggggttcttaaagaa >IGR2108a
tattgaggccctaaattaagtctacagaattaggcctaaactccgcagacagtagccaaa
ggtctcaggctctggcccactccacctgtccatccacacctccttctcatcttgcccttc
actcacttaacacagtgcccaaagggagatgcagttgcctggacaggctggctttggctt
aagctaggggttcttaaagaatagtccccagaccagcagcatcagcatccacctgggactt
gttagacctcctgaattggaacctgtgggatgagactcagcaaactgttttaatgagtct
tctaggtgattttggttgcactaaagtttgagaaccactgggtgagccattccctgagcc
caggttgcccttctcagccattttctgcctattataatctcaaccacctttcaaagttca
gctcaataccatctcttttgggaagcccccgtagtccccaagtacttgtgaaggcctct
tccttgaaccgacagcttctttgtcacccccatccccccattctagtgaaagaccttcattt
ctgcttctctttgcagcatgtattttctgctttgttttatagtaaactttgagcagttgt
taactgccttcccacactgattcccctctaacacacaaatgttactctgtaaaggccatg
tcttacttcactcattcttttttatttttttattttttgaaa >IGR2109a
tttgtcaccccatcccccattctagtgaaagaccttcatttctgcttctctttgcagcat
gtattttctgctttgttttatagtaaactttgagcagttgtccttcccacactg
attcccctctaacacacaaatgttactctgtaaaggccatgtcttacttcactcattctt
ttttatttttattttttgaaacaaggtctggctctgttgtccaggctggagtgcagtggc
atgatgttggctcactgcaacctctgactcctgggctcatgtcatcctcccacctcagcc
tcccaagtagctgggattacaggcctgtgctactgcgcccggctaatttttgtattttta
gtagagacagggtttccccatgttggccaggctggtctcggtctagactcaagtgatccg
cccaccttaacctcccaaagtactgggattacaggagtgagccactgcgcctggtgcaat
ttgctcattctttgaataaatgtccactgaggatctgctctacatggcgggggctgtgct
aggcactgggttcagacaaaggtgcacccttatacttatcatccaggagccagtggggt
gaatggcaaggtggctggcaattgcaatactttgagtagcactgagacagaatgcttcca
accaggggggcccctcatgccccctccctgttgggaccc >IGR2110a
atgtccactgaggatctgctctacatggcgggggctgtgctaggcactgggttcagaca
aaggtgcacccttatacttatcatccaggagccagtggggtgaatggcaaggtggctggc
aattgcaatactttgagtagcactgagacagaatgcttccaaccacaggggggcccccctca
tgcccctccctgttgggacccacccaaaaagtaacctctgttctaacttccatcaccaga
gattaatttatctgtttttgccttttgtttgagacaggg tcttctgtcgtccagga
tggagtgcagtggtgcgatcatagcccagtgcagcctcaaacgcctagactcaagcagtc
ctcccacctcagcctcttgtgtagctaggactacaggcatgtgccaccatgcccagctat
ttttttttttttttaaagagacagagtcttgctatgttgcccaggctggtctcaaactcct
ggtctcaagcattcctcctgtcttgacctcccagagtgctgggattacaggtataagcca
ccgcacccggccaatttatttgttttaaacttcatataaatagaatcatacaatgtac
ctttcggtgtctggcttcttcccactacacattatctgtgcgatccatgtatgctgtta
tgtatagacacagtttgttctttttaagattgctgtgtt TABLE 5-continued >IGR2111a
gtcttgacctcccagagtgctgggattacaggtataagccaccgcacccggccaatttta
tttgttttttaaacttcatataaatagaatcatacaatgtaccttttcgggtgtctggcttc
ttcccactacacattatctgtgcgatccatgtatgctgttatgtatagacacagtttgtt
ctttttttaagattgctgtgttgtatcccattgtgtagatatgacacaatttaaccattct
actgttgatggccatttgtgttgtttctagtttgggggctcttatggagaaagatactatt
agacataagacaaaaacatttggtttatgtccgctggtggacattctggacattcgcac
tcattcctcttgagtatgtacctagaggtggaactgatggttttatggaatgggtatagtc
ttagctttagtagatactatcaaatagttttccaaagtgattgtaccaatgtacactcct
accagcatataaaagtgtttgccaacatttggtatcatcagtcttcaatttagtccttc
ctgtgggtatagagttgtatcttttacgttttaatttgcttattggctatttatatatcc
acttttaagatgttcctgtttaagacttttgcctatttgcttttttcttatttacttaca
ggaattctttggaccttctggatataagccccagtcgtct >IGR2112a
tgccaacatttggtatcatcagtcttcaatttagtccttcctgtgggtatagagttgta
tcttttacgttttaatttgcttattggctatttatatatccacttttaagatgttcctgt
ttaagacttttgcctatttgcttttttcttatttacttacaggaattctttggaccttct
ggatataagccccagtcgtctgtcggatatgttacagagaatatcctctcctcttccagt
ctctggctcgcctttccactaggttttttgtttttttttttctgagacagagtctcgctc
tctcacccaggctggagtgcatggcatgatctcggctcactacaacctccacctcccgag
ttcaagtgattctcctgcctcagcgtcccgggtagctgagactacaggtgcccaccacca
tgcccggctaatctttgtattttcagtagagacgggattttcaccatattggccaggctgg
tctcgaactcctgacttgtgatccgcccatctcagcctcccaaagtgccgggattacagg
tgtgagccaccgcacccagacgccttttccactctttaatggtattttgatgaacaaaag
ttcataaatgttcaatttaccccatcttttcatctatggctagtgtatcctgcttaagtaa
tcttagttccaagaagtccagttaacagaaataacaaaaa >IGR2113a
gatccgcccatctcagcctcccaaagtgccgggattacaggtgtgagccaccgcacccag
acgccttttccactctttaatggtattttgatgaacaaaagttcataaatgttcaattta
cccatcttttcatctatggctagtgtatcctgcttaagtaatcttagttccaagaagtcc
agttaacagaaataacaaaaattactaatattaaaaaagacaaagaagtgaaggaaaaaa
ttggatggtgggtgtgggagaaggactgcatcagatcgtgagagtgtgctcacttgactg
tgctgtgcaaagcccgggccttgtcctgtgttgtggtatggatgggagctgaaccccccag
gcagtgcaacaaacatgccctctgtttggttcagatgctgcgccaggtggtggaaagggc
tctgtgggctgtaggggggaccctggctcaatggcttaagagaaagatcactccttttcat
gtgtgttaagctgggtctgaccccaaaccctggagactccctttagtccaggccctgcg
cctctgtgccagagcctgcaaagacagcagtgctgacacttgtccagctggctcacaaag
gggaaattctcccctccttgagtcaccacatagacaggaggagcttcaaataacaagcgc
tcgactccaaacgatccctatgctcatttcacgatgctgc >IGR2114a
accccccaaaccctggagactccctttagtccaggccctgcgcctctgtgccagagcctgc
aaagacagcagtgctgacacttgtccagctggctcacaaaggggaaattctcccctcctt
gagtcaccacatagacaggaggagcttcaaataacaagcgctcgactccaaacgatccct
atgctcatttcacgatgctgcatcactttcaaaatcccctgtgatgcttgtgtatgaagt
ctagatccagaaactttccccatgttttcccccagtttgagtagaacaataccctgggagt
cacaagctacatcatacaattgacttccctaaaaaaaaaaaaaaaaaaagagatcttgga
ctcaaggttatgagtttgcagtgtcctttgcagggtcttttaaatcccctagtggcatat
gaaactctggatgtttgtgaattttcctggggaaagggtctatgtgtgccatcagattcc
ggaagggggtgtatgacctcaaaaaaaggtaagactcactggaccgagtcccctttaagga
tagtttgcagtcctcttctgctggggaggtgatggtagtaggcttgccaagaggacctcaa
cctaccagatggatgcgatctgccatccacctccccagcataaagccagttcataaagcc
agctccagcatctctggggcagttttcttcccatccaggg >IGR2115a
aaaaaaaggtaagactcactggaccgagtcccctttaaggatagtttgcagtcctcttct
gctggggaggtgatggtagtaggcttgccaagaggacctcaacctaccagatggatgcgat
ctgccatccacctccccagcataaagccagttcataaagccagctccagcatctctgggg
cagttttcttcccatccagggtcaagctcttggcggcttagagatgcagtgtgccagtcc
caacaccatggctgtgtgtcactgcagatgaaggcatacttttttttctaggacgtgcagt
gaccccacttggcagcagacactcatttctgatattttgtatgccaagtcttgggtaaa
acaactaagtgatctcttaaggaccaggttcctttttttgtccctgttccttgccctca
ccaccactttttccatgtgccaccctctcataagaactcagaagcccagggtggagtcaa
aggggtcttttaaatcccctagtggcatatgaaattctggatgtttgtgaattttcctgg
ggaaagggtctatgtgtgccattagattctggaaggggtgtgtgacctcaaaaaaaggtt
aagacccactggaccgagtcctctttaaatggaagtgcatggatcagtttgataaaatta
atttatagtaatgagctatgtatctttagctaactgcact >IGR2116a
tagtggcatatgaaattctggatgtttgtgaattttcctggggaaagggtctatgtgtgc
cattagattctggaaggggtgtgtgacctcaaaaaaaggttaagacccactggaccgagt
cctctttaaatggaagtgcatggatcagtttgataaaattaatttatagtaatgagctat
gtatctttagctaactgcacttctaaaaagacatctgggaaggagaacgcttaactaaa
attattattataattattattttttgagatggagtattgctcttgtcgcccccaggctgg
agtgcaatggcacgatctcagctcactgcaacctctgcctcccaggttcatgcaattctt
gtgcctcagcctcctgagtagctggaattagaggtgcccaccaccatgcccagctaattt
ttgtattttagtggagacaggtttcaccatgttgcccaggctggtctttaactcctga TABLE 5-continued cctcaagtaatctgcccacctcagcctcccaaagtgttgggattataggcatgagccact
gcacctgacctaaaattatatttctaatgacaaaactgaggtacagctcataactaaata
ggggagaatgacattaaagccactcccatcactaaaaaagaccaattttctggtctaga
tggcttttagaggctcctggagcaggaacaaggggttag >IGR2117a
ctcagcctcccaaagtgttgggattataggcatgagccactgcacctgacctaaaattat
atttctaatgacaaaactgaggtacagctcataactaaatagggggagaatgacattaaag
ccactcccatcactaaaaaagaccaattttctggtctagatggcttttagaggctcct
ggagcaggaacaaggggttagtgactacgatgtgtcaaaagagacataggcatttctcag
ataaacctcagctcttccggcttgagagaaggaaacattcccaacatgacttaggggccc
aaggaccctgtttccacctcatatcagattgtcaaatgggaagggtgtgcctagggcaca
cactccctcccgaaagggctgagtccccagaagacctatgtctgctccatcctggctccc
tgctctctcctggagacaagatacagctgcctgtatgagtagcagtctgggcctcctcc
tccctccctctgccccaccccactcctccctgcccgcccccatacacactgggttcttcc
tcccctgctctctcaagaagccaggcccctgcccccactcacagtcagaaggaagtga
ttctgcaaggcctcccagggactcccaggactggctcaaggcatcagactgttaaataag
tgggattttttcagtgtttgtagaaactgttgtttaaaaa >IGR2118a
ccactcctccctgcccgccccccatacacactgggttcttcctcccctgctctctctcaag
aagccaggcccctgcccccactcacagtcagaaggaagtgattctgcaaggcctcccagg
gactcccaggactggctcaaggcatcagactgttaaataagtgggattttttcagtgttt
gtagaaactgttgtttaaaaagatgtaaccatccaaactgtttatgtaacccttgggaag
tctcaacagatatggttccctatttataactgtggccaggactttaaaaatacaagtgga
ggggactgtcaaaatcagagaggttgtcacgttacagttgtatgcttgcataactgaat
tcagtattttgctctaatttgagaagtttcttttttattcacttttctccttttctggttt
tctcttccttttgttgtccactgctgtgcaccatacacctgacatttttctgagaacatc
agaactatttctctgaagtggaggttcaaaataggggttttttagaatgaccaaataataa
tgaacactaaaattcatttcaaagcctaggactagtctattcatactgatattcctagtc
tacaagggtaaacatagctgtcttctcgccgccagcccctacacctgcaggggcctgctc
tgtctctgggttgtccgctctggaggtaggtgtcagacca >IGR2119a
ggaggttcaaaatagggttttttagaatgaccaaataataatgaacactaaaattcattt
caaagcctaggactagtctattcatactgatattcctagtctacaagggtaaacatagct
gtcttctcgccgccagcccctacacctgcaggggcctgctctgtctctgggttgtccgct
ctggaggtaggtgtcagaccacctggtctcactttcctaggtccaatctctggatctatg
gcaacagaatccacaggtccctattcccatacaggggaatgcaaagttgctggggaca
atcacagtcaaagctgagatctgggcttcttctagagccattctgaggtcttcatcac
tcacactaacaatccaactaaaacctggctcttgtaggaacacatcctcttcttattag
ggaggctgttctctgagttaacatagtagcagtttcgttcacagatcttctggcaaaaa
agaatccgacgagagctatgcctccaccaaaggcacagtttgataacactttggggaagg
atggttcatagctcctgaagaagaaagagtctgtgataagaacctctggcccacaggctt
cttcacactacacaacttccaaaatccctaaccactgctaatagctaggaggaggatagt
gactgttcccaacacaaagagatgacaaacatttgagatg >IGR2120a
gcctccaccaaaggcacagtttgataacactttggggaaggatggttcatagctcctgaa
gaagaaagagtctgtgataagaacctctggcccacaggcttcttcacactacacaacttc
caaaatccctaaccactgctaatagctaggaggaggatagtgactgttcccaacacaaag
agatgacaaacatttgagatggtggatatgctaattaccctgatgtgatcactatacata
atatgtattgaaacatcattatgtaccttgtaaatatgtataatcattataacacacaat
atgaggtcccagacaatgataatacataataattatacgtttatgggatacatagtgatg
tttcaatatgtataaattgaagtggtgtgaattatgtataaattttaactacattaaaaa
ttacagaaaaataaattttaaaaaacaaaacaaaaaaaattcttaactgctgtcaagcta
gcactgacaaccgaagcctcagcccagtacctccctgcttccacctgtgctgaccaccct
aagagagaaggcagaggcacacagcccttacatcttggtggggaaacctagggtttcct
ctgagggcctgacagattgaaggggttgaaaatgagtggagggtgtggccacctcagctc
tagcctccttctgctgagggacagtggccaaggaacatcc >IGR2121a
cagcccagtacctccctgcttccacctgtgctgaccaccctaagagagaaggcagaggca
cacagcccttacatcttggtggggaaacctagggtttcctctgagggcctgacagattg
aaggggttgaaaatgagtggagggtgtggccacctcagctctagcctccttctgctgagg
gacagtggccaaggaacatcctcatagatccaaaggaaggtgagagtccctctttgtcc
tctccacccacctcatccccaccacgccctgatgtcactccctgctgtacccaccccgga
aacccttagccacttcccacaggtccactcccagggaagttctttaattggtggatgtgg
gaaagaggaagaggaaaaatatcatttctaccttcccaattccctgtatcccatgagcct
ccagtctgaaaatgattacccatctgacctggagctctcatcctaggtatcataatggct
cttcttttacccataaggagaatgggtaatgaagaaatgcaaaatcccaactcatgaaaa
tgtggttgaaaaagggaagacccataaaagttctcatttgttgaccagagacaataaagt
gattacttaaaaaaaaaaaacccacctctggggtctttccaaatcatggagaaaaataa
aaacaggggaagacatgctctagtcttaaaactccaatgt >IGR2122a
gaatgggtaatgaagaaatgcaaaatcccaactcatgaaaatgtggttgaaaaagggaag
acccataaaagttctcatttgttgaccagagacaataaagtgattacttaaaaaaaaaaa
aacccacctctggggtctttccaaatcatggagaaaaataaaaacaggggaagacatgct TABLE 5-continued ctagtcttaaaactccaatgtggccccagactggtgagccccaacaacagtaaataccca
ccctcagcagccttctgcccacctcaccccaccaatactaggtcccagacaagtcaacaa
acacttattgaccatgtactgtgtgcttccaaccattccgggagttggaattctgcaacc
tcaaggtgctttgcgaggagcagggaaacagctcagtcaacatttactgtgtgctgacgt
tttgctaggtttagaggaggcaaaaatctgagaaaaaaacagctaagaatactccaatct
gggaagtactaatatacacatagcaccataggagcaaggaacaattaattctacatggtg
aggtcaaccagagaagatgattttttaagttgggccttgaaagcacattaggattttgctg
ggtataactgggaaggagtggcattccaggcagaaagaactgagtgagcaaaggtcaggg
ttggggttggtatgggcagttggttgtatgtgatacggcg >IGR2123a
atagcaccataggagcaaggaacaattaattctacatggtgaggtcaaccagagaagatg
attttttaagttgggccttgaaagcacattaggattttgctgggtataactgggaaggagt
ggcattccaggcagaaagaactgagtgagcaaaggtcaggggttggggttggtatgggcag
ttggttgtatgtgatacggcgtgtagtcaggccagtgttgccagaacacgggtcagaga
gcaagagcaaaggaggtaaggctaaaaggcaggctgcagtttatggcagccacgaacaca
tgccattcaaaggacctgttgcatggagtgcagacagctgacaggctgcagcctcggatc
cacaccattcaagtcagaccatgttgcctcctgggtggccccagccaatgacagaacat
ggcagggttgctcgggcctgtccatttctgcccaaagtgcgactcttctcctgggcaatc
tttggctggaactccccactgggctcgttgagacactcttacagccgcatcacagtctga
tgctctttcaacagaattatccttccctctcttgcgtcccagagttagatctggactgca
gtctgaaagctgtcttttctctccgtacttctgctcctttctcctttatctttcataggc
attagctcttcttaccccaataaatcttctgcactttc >IGR2124a
tgggctcgttgagacactcttacagccgcatcacagtctgatgctctttcaacagaatta
tccttccctctcttgcgtcccagagttagatctggactgcagtctgaaagctgtcttttc
tctccgtacttctgctcctttctcctttatctttcataggcattagctcttcttacccc
aataaatcttctgcacttttcattctgttttggtgtctgcttcccagagactccaactg
agaaggagcttagatgaatgtttgggttttgctgacagtgaggagccactgagtgatttt
aaacagggcaagccatggtcagatctgagtttcataaaagcaattctagcactagggtga
agagccgggggtggggagacagggaagcaacaggcaatgaaaagacccatttaaaaggac
actgcactgattggtacaaggtttcaacaaggggcaactggaagtatacaacttacta
tgtatataccctttaactcaacagtctcaattgtagaaatctattttatagaaacactag
cacaaatgcataaaagtataaaaatgaggatgtagtggcctataaatattatcaggacat
tgaaaaactttgtggtcatctgtaggggaggagatgaactagcagtacatctacgtggtg
gaatacataccaagcagcctttaaaaagaagacagcaggt >IGR2125a
aacagtctcaattgtagaaatctattttatagaaacactagcacaaatgcataaaagtat
aaaaatgaggatgtagtggcctataaatattatcaggacattgaaaaactttgtggtcat
ctgtaggggaggagatgaactagcagtacatctacgtggtggaatacataccaagcagcc
tttaaaaagaagacagcaggtctctatgtactgtcatagagaaatatacacaatagactg
ctatttgtaaaagccggttgctagccgggagtggtggctcacgcctgtaatcccagcac
tttgggagactgaggcgggtggatcacctgaggtcaggagtttgagaccagcctggccaa
catggtgcaaccttgtctctactaaaaatacaaaaattagttgggcgtagtggcgggtgc
ctgtaatcccagctacttgggaggctgaggctggagaatcgcttgaacctgggaggtgga
ggttgcagtgagccaagattgtgtcactgcactccagcctgggcaacagagtgagactct
gtctcaaaaaaaaaaaaaaaaaaagccagttgctgtacaaagtatatagcatgctccc
attttcatgaacaaagctgtgcatacgtatatttataaagatccacatttgtttgtataa
ataagtctggaaagagatatatcaactgttgacagaggtc >IGR2126a
tgtgtcactgcactccagcctgggcaacagagtgagactctgtctcaaaaaaaaaaaaa
aaaaaaagccagttgctgtacaaagtatatagcatgctcccattttcatgaacaaagctg
tgcatacgtatatttataaagatccacatttgtttgtataaataagtctggaaagagata
tatcaactgttgacagaggtcacctcttgaaggtggtagggctttcacttttttactttct
atgttgtttttatttttctttggtgcttttctataatatattttctacttcttaaaatgat
gaagatggttcatttctctcttatcagaacacaaaattttaatttaaaaagcttcatatcta
cttagaaaaccatataaaaattctttatattgtatttccagagaagaaataacaaaaatc
tcctagaatcgttgagagggctgtcagcggcctggtctcggtaaagagaaattagagatg
agttgaatagagccgaacacagggtggtgaagacagaagttccagaagaagccaagagt
gctatcttgagtagtgggcaggtgacccacagaagggcggttgggtggggaagtaggagtga
gaggggtctgtgctgaatgtgccagccttcaggaggctcaggccaggacagggtgtataa
acaagaggtgacgctggctcctgctttagaactcaggaga >IGR2127a
acaggggtggtgaagacagaagttccagaagaagccaagagtgctatcttgagtagtgggc
aggtgacccacagaagggcggtgggtggggaagtaggagtgagaggggtctgtgctgaatg
tgccagccttcaggaggctcaggccaggacagggtgtataaacaagaggtgacgctggct
cctgctttagaactcaggagatatttaggcctaaacacttatgcctactacaaaagattaa
aaacttaccaacagtactcaccaatggactaaaacgctaattgtaaacagtgaagtcatt
gaaaaaccagaaaatattggtgaatacttatctaaggggggaagaattttggataaaag
agcaaacagcattttaaagaaattttagccatattaaaaacaaacaccaagacttaaaa
acagaactcataaacaaaatcaaaagacaagcaaaaacaaggaattatatttacagcaac
actgacagaaaggacatgtccttcatatataaaaaacatatggttgggtgtggctcatgc
ctgtaatcccagcactttgagaggccagcatgggtggatcacttgaggtcaggagtttga
gaccagcttgggcaacatggtgaaaccgtgtctctactaaaatacaaaaatttagctggg
catggaggcttgcgcctgtaatgccagctactcaggaggt TABLE 5-continued >IGR2128a
ccttcatatataaaaaacatatggttgggtgtggctcatgcctgtaatcccagcactttg
agaggccagcatgggtggatcacttgaggtcaggagtttgagaccagcttgggcaacatg
gtgaaaccgtgtctctactaaaatacaaaaatttagctgggcatggaggcttgcgcctgt
aatgccagctactcaggaggttaaggaaggagaatcgctggaattgaggaggcagagttt
gcaatgagctgagattgcaccactgcactccagccaaggagacagagtgagacttcatat
aaaaaaaaaagcaaaaaacaaaacaacaacaacaaaacccaaaaaacacagatgagt
ttgtaatcagtaataaaaatacactctccaaagaaaaacagcactggagctgggcatggt
ggtatgtgcctgtaatcccatctactcaggggggccaaggtgggaggattgcttgagccca
ggagttcaaggccagcttgggtaacacagcaagatcccatctctataaaaaataagttag
ccaggtatggtggtgcacacttgtagttctagctactctggaggctgaggtaaaaggatt
gcttgagcccaggagttcgaggctgcagtgagctatgattgtgccactgcgctccagtct
ggttgacaaagcaaggccctgtctcttaaaaaaagaaaga >IGR2129a
ggtaacacagcaagatcccatctctataaaaaataagttagccaggtatggtggtgcaca
cttgtagttctagctactctggaggctgaggtaaaaggattgcttgagcccaggagttcg
aggctgcagtgagctatgattgtgccactgcgctccagtctggttgacaaagcaaggccc
tgtctcttaaaaaagaaagaaaaagaaaaacagcattgattatggtattgtgtattata
aacattattttgtattggtagaattttgttcagttacataaaacagaaaacaatagtgg
cttaagcaagatggggttttctttctttctcactgaaaaaaaaggtctagaaatgatc
agttcagggctggtttggtgacttcaggtgtcaccagggacctacgcttcttctggctca
tcctgccccctattcctaaagtgcagctctcattctcatgtcttgtggtagttgctagagt
gatagtcaccacatcctcatttaagaaagtaggatgggagaaaggagggtgaataaagggc
acacccctcctgttaaggagctggcttcgaagtcccatatgacacccacttgcatccat
tgtccggaacccagccacatgatcacactttgctgcaaaattgccaggggaacgtagttt
tcagctgggtggaaagggatcagcaaaaaattggttttg >IGR2130a
tttaagaaagtaggatggagaaaggagggtgaataaagggcacacccctcctgttaagg
agctggcttcgaagtcccatatgacacccacttgcatccattgtccggaacccagccaca
tgatcacactttgctgcaaaattgccaggggaacgtagttttcagctgggtggaaagggg
atcagcaaaaaattggttttgttactaagaaagagggaatggatactgtagagcaatgag
cagtttctaacatacatgtgaacaaaattatcaaaagaaatacaaatgtaaaagatttca
gggtcaaccttaccaacagtcaaatataagtaaagcaggtggcctttttatggtcttgtct
ggctaaggtattgaagagctggccagacaagtcatgaagcagtcaagaactgactgtct
tcataaggaccgactgtcttcataagaaccttgggacaatgcacatgaacagaacagagt
ttcagggtaaaaatggccctttctccccaactagatggctcaaggacccaagggccactt
cctggctgttcccccaaagtctccctccaactcccaagtgacatcagattctgtaaatgc
tgggaagtagagaaaaattctgtacccaggggattctctaactaaactatggctaaaatta
aattttaggtgtttttgaaagttccttttaaaaagtaata >IGR2131a
tttctcccccaactagatggctcaaggacccaagggccacttcctggctgttcccccaaag
tctccctccaactcccaagtgacatcagattctgtaaatgctgggaagtagagaaaaatt
ctgtacccaggggattctctaactaaactatggctaaaattaaattttaggtgttttttgaa
agttcctttaaaaaagtaatatcctcatgcaaactgaatcagcagtttcagaacttaaaa
aaaaaaaagaacctctgtcgtattcttggggtatcacaaattaaacatgaaaaccagcc
actaaaataaggaccagtgtttggatactacatgggggtgatgttaggcaacctcaagtt
atgtctttggcagattcaggactttatgtgagctcccacagatggtgatgtcaatgcca
ccacccttcagaaggcacagagaaggaaagtgcagaggacacggcaagtgtggattccac
aggcttctgaagttcataggcctatttttgaatagttattgtgcctttctcaatccagacc
agcatcagttacctctcacgatttatttgaaagcatttacttctagtgtttgctcttttt
aaatggttgctgattgggaaaaataccagagtaaactgatgtttcatgaagtctggggga
gacgatctttagggcatgggaagcaatatgatataatgac >IGR2132a
gcctattttgaatagttattgtgcctttctcaatccagaccagcatcagttacctctcac
gatttatttgaaagcatttacttctagtgtttgctcttttttaaatggttgctgattggga
aaaataccagagtaaactgatgtttcatgaagtctgggggagacgatctttagggcatgg
gaagcaatatgatataatgacgaaacgtgcccatgctttggaatcagaaacacctggatt
tgagacctagctctgtggtttaccagctgtgtgttctgggacaagttattaaacttctct
ggggctcaggttccttgtcttaagatgggctaatacagtgcttacctcgttgtatcatca
agttgggtaggaaacagatggtgaacttggactgggactgtttacaaaggtgtgggagg
gctcagggaaatcaagatgagacagtgaagcatatgggggctagcaacaatgggagctg
ttaccacttgtaacctgaaggtatgaaggaaggggaataaatggtgtaagggggacccaaagg
aggcagctattggaagggtgtctggcaggagctgtgggctccagtggaggatgcagttgg
cctaaagcgacctgataggggacccgggggaataacttaaccacttgccctcctcggggaa
ctcctgacctcatcttcctgagtccttccatctcttgcta >IGR2133a
ggtatgaaggaagggaataaatgggtaaggggacccaaaggaggcagctattggaagggt
gtctggcaggagctgtgggctccagtggaggatgcagttggcctaaagcgacctgatagg
gacccggggggaataacttaaccacttgccctcctcggggaactcctgacctcatcttcct
gagtccttccatctcttgctaatgctccccatggaccaaatctaactagaatccagaggc
aagatagatgagtgatgtggcccattcaggtcagcctcccaacccagagcaggtagagag
gacggagagtggatctgcaggagcaaacagaagattaatcaaaatagagactgtgatgag
gttagcataatgcctggaacatagtaagtcccacaagtcctcaacaaatgttaattttattt TABLE 5-continued tggactttggactctctgtctgcctgttttgcttattgcttacttcctggttttcatcag
ctcatgtatagttgagataacttccaaataatcaagtattgttatctatattggagtgtt
ttgaaggagtaatgagtgtataaaaaagataaccagatactctggggattagagatgaca
gagggaaacagaggaagggagtaagtaagagaaaaggatggagaaaactgtatgttccc
tatgaggctggaatgaacgcaagattatcttactttaaaa >IGR2134a
acttccaaataatcaagtattgttatctatattggagtgttttgaaggagtaatgagtgt
ataaaaaagataaccagatactctggggattagagatgacagagggaaacagaggaaggg
gagtaagtaagagaaaaggatggagaaaactgtatgttccctatgaggctggaatgaacg
caagattatcttactttaaaatcaaatcatgcacttattgggatgtgataacagtgcgtt
tgcaattttacagcccagtgagacttgccagaaagggattttgcaaggaaggtcttcctg
ccctaaaggaaaacctagtgcttacttccagattaataagtcttaacccatcatgcctgc
tcccccaaaaccaagtagtcaaatgtgttaacctggatgtttaaatacctgcatgttcct
gcctgggtgcctgggtcaggtgaatgttctattctgatttgggaaatggctagagtgtgt
tggtcgtcgcctgggatagctcccaggtaggaagggagcccccagagagtggtctgaacag
tgactcataaactcagtgtcctttcctccagcctttaccagctgctgacttggcccctta
ggaatctgtcttcattccgcaagctattctccagtgtctggttcaggctctagagcagag
cattccaggctttctgtgattcctggccacctgttccatc >IGR2135a
ctcccaggtaggaagggagccccagagagtggtctgaacagtgactcataaactcagtgt
cctttcctccagcctttaccagctgctgacttggccccttaggaatctgtcttcattccg
caagctattctccagtgtctggttcaggctctagagcagagcattccaggctttctgtga
ttcctggccacctgttccatctccaagaccctccagcatcctctctcatttgcttaccc
taccctccaggcctttgcacaggccactctctgtgcctgggacatacattctccttctgg
ctaaccttccgcagcctccaggacctctcaggtgtcctctcctctgggagccctgctgga
ctgcccacggggagtgggaagcccttctgtatgctcctgttagccctctttgattctct
cactcacagcacttccacactgtcttggtttcctggctcatctctcccaacacactggac
acccctttgagaagagacttgacatattcatcttgattttaatgccatccggcaaaattcc
tggcactcagagggcatgcaataaaactttactgaatgaaggtttagcgcgtaattcaga
aaataagcaagaaagtgtcacaaacaccaaagcaagttaaccaagctatatgttctagaa
cattcttcctctcctcctgtcactctggctctcctgcgcc >IGR2136a
gacatattcatcttgattttaatgccatccggcaaaattcctggcactcagagggcatgc
aataaaactttactgaatgaaggtttagcgcgtaattcagaaaataagcaagaaagtgtc
acaaacaccaaagcaagttaaccaagctatatgttctagaacattcttcctctcctcctg
tcactctggctctcctgcgccacagcagacaggacagagtctgctctttcacctgctct
tttctagtcttttctttcaggtatccctgaaatgccacttcctcagaggctatccttga
ctacccaatccaaagcagtcactcagtcacttgattacacttcagtctattttaatttgt
tagagagcacttactgctagcaccaatgttttatttctgtgttttctttctatctccacc
attatgctgtagctccatttgagcagggaccttgtctgttcactactgtatgcccagcat
ctagtacagtgtgtggcagagagtcaagtgttcattaaatacttgttaaatgaatgcatg
ccactgttactgcatgctgagttaatttgatgtatggcttctatcactgctatcagatta
ggtgctctagagaaaactcagaaagggctgagtctccttatgacattgcagggtgggaggg
ggacctcagttcccttcctaggcctaagtgggatatgctg >IGR2137a
agagtcaagtgttcattaaatacttgttaaatgaatgcatgccactgttactgcatgctg
agttaatttgatgtatggcttctatcactgctatcagattaggtgctctagagaaaactca
gaaagggctgagtctccttatgacattgcagggtgggagggggacctcagttcccttcct
aggcctaagtgggatatgctgcctgcttgcagcttccttgtggcctggacttccccatgg
aggccagatgctgagcaacccagcccatgtgtctgaaggctctgaataccgaaatgttc
ctctagctttctgtgagagcagttggagctgcccattgcctacactgatagaggaatgtg
cccagggctcctggctggcctggcacccagcaggaggcaggcacagtggccagcacggtg
aggacacatcacacttcttcttttttcccatatccctatgctgagagtgcatgcagctgcc
tggctgggagcagaaactggcctcactttctggggcctgctgggcagacaatgcagctct
ctagctgtgccacagaacagggcaaatctttactagctgtggactcactccctgccccctc
ccattcctcagaaattgctctaccagctcagcagagggccaggtctggaatctctcacc
tgtccctggcccttcctttaagccctctggtttactggaa >IGR2138a
gcctcactttctggggcctgctgggcagacaatgcagctctctagctgtgccacagaaca
gggcaaatctttactagctgtggactcactccctgccccctccattcctgcagaaattgc
tctaccagctcagcagagggccaggtctggaatctctcacctgtccctggcccttcctttt
aagccctctggtttactggaaatcataaactgtgagacacagccttttatcacaccctgaa
cagttcactcttaatatttaatgctggaggctaaaacaaccagggacactggaggcctcc
tgcttactctcagtgactgatgtttgcacctggtaattgaggtcaggttgcttctcttaa
gtcacatgatttgcgtcaaagcaggaaggtgtcggggccacttgttgcaaagagaccagg
aggcgatcccagcaacgctgcaaaccagcttttggcagcaaaggctgtgctttcatgggag
ccagcccta ggagtgtggagctgggctggcagctggtaaatgaccctctcggggcctgaa
taaaccctagcttttcactcacagcaaactcaggatgccttcctccctctaaaagacctg
ctgaattgagtcactttcaatcctttctggagtaggatggggcattagttaattaacaaa
ttaattaagcatgctaaatagtcacccagaagatactggt >IGR2139a
gctgggctggcagctggtaaatgaccctctcggggcctgaataaaccctagcttttcact
cacagcaaactcaggatgccttcctccctctaaaagacctgctgaattgagtcactttca TABLE 5-continued atcctttctggagtaggatggggcattagttaattaacaaattaattaagcatgctaaat
agtcacccagaagatactggtcacttaagggtctccaaatcacagtataggtcccaccct
acccagacacctaatcttgtttcagggtttgcttgacctcaggcatttatctcctggttg
tcatggaatctgctcagataaacagcagcacaccaacctggcccctctgccagcctcaga
tccttctaaggcagtggagctccctggtggccaccagccacccgggctccaggcagccca
acacacactccatgctgaggtctctcgcatgacctctctaggcacacagtaggtgctca
gtaaatgctgtggcatgaaggaccctcctggagtgtctgagttctcaggcttcaaggccc
ctagataagcagatttctctcccctatcaccatagtcaccccagggactgcagggcaggc
cgaaatcagccagtgactcagctccttgggcaattcagctggcccacagaccacttcctc
tgctccccagcgccggatggatgcagatctgtgagtaagg >IGR2140a
ggaccctcctggagtgtctgagttctcaggcttcaaggcccctagataagcagatttctc
tcccctatcaccatagtcaccccagggactgcagggcaggccgaaatcagccagtgactc
agctccttgggcaattcagctggcccacagaccacttcctctgctccccagcgccggatg
gatgcagatctgtgagtaaggagccagctgcaggcaagcagctgtgggctcaggtgggcat
gatgtctggctaccactcgcactggacgccacacacacagccagggtggcagaaggcccc
acctgccatgtgccagtgggacaccacccctcatggtctgcgtttccaggtttccaactaa
ggactgagcacactctcaacatggacctcctaactgctctcgaggatggacagctggcct
caagggaacactgcaaagtggctctaggaagaagccactgtccctccagaccataaaaat
ggctaccaagggcagagccagcagcttttcgctgtaaagtttctcaagaaaatcacagata
ttcccctctgtgatgttcagctcagcctgaaaggaggtaagaaagaccagactacctga
tctctcaaggtcaccaaattcaaccactgtcctgtttaaaagcgggtagtacagaggcca
gtgtgggctctggaatgagacatgtgaagcccgggtctgc >IGR2141a
agcagctttcgctgtaaagtttctcaagaaaatcacagatattcccctctgtgatgttca
gctcagcctggaaaggaggtaagaaagaccagactacctgatctctcaaggtcaccaaat
tcaaccactgtcctgtttaaaagcgggtagtacagaggccagtgtgggctctggaatgag
acatgtgaagcccgggtctgctgggtctgctgcacggtagcagtgtagtcttaggcatta
ttgaaactctgtttctaaatctggttatgtgaatgaaaggggctaatttatgtaacactt
ttagtatactaagccctcaatatagtttagctacttaactattgtcttctttgaaggacg
ctgaactaaacagaagagaaacagggaaataaacagcatgcaacctacatcaacagaaa
cttaattattcaccctggataactgagtgtgtgagtgtgactgcaaataacaatatagca
aagagaagtttgagatctttggctcagtcattctagaatcctgagtcacagcaaatgcac
agcctccatgaggctgagccacacatgaaagctgcttccacccacagactggtagaggcc
actgacatgcttaacgatgatgatgatgataaaaatagctaccacgggctaccacgtgca
cacacatgttaagcagttcaaacaggttattttgtttaat >IGR2142a
tggctcagtcattctagaatcctgagtcacagcaaatgcacagcctccatgaggctgagc
cacacatgaaagctgcttccacccacagactggtagaggccactgacatgcttaacgatg
atgatgatgataaaaatagctaccacgggctaccacgtgcacacacatgttaagcagttc
aaacaggttattttgtttaattcataccacaaatctttgaggtaagtattcttgttcccg
ttttatagaggtagaaactgagagttgaagaggctgaataatttctcaagcacactccca
actcgaccacccacaagcaaaaggcagagctgggattcaaacacaggtatgactgtgtg
tggacatctcccctgtgctatgctccctgaaggaaaattctaagtggtgttgtttctggg
agaaatctacctgtgtggtctttaaacctactctgacaggagcaagggccaccactctgt
atctaagaccactgggaacagtcttcaggcaacaaggtgaccagggcagctgcagagggt
atctatgcccctgcccctagcgcaaaagtctgtttctcttccaaatgcccgctggga
gcaactatttagggagaccatacctcctcccacactcagttcccaggcctgagccacaga
gtcctgccacaggagggaggacctgcctgtcctgctccct >IGR2143a
agtcttcaggcaacaaggtgaccagggcagctgcagagggtatctatgcccctgcccct
agcgcaaaagtctgtttctcttccaaatgcccgctgggagcaactatttagggagacc
atacctcctcccacactcagttcccaggcctgagccacagagtcctgccacaggagggag
gacctgcctgtcctgctccctccccactccaggttcctggaggcctctgtgatgattccc
caggaaggactacaggatctggcaggcagcaggtggcggtgggaggaggagtcctggg
agcacagcactcctaaccccctctgcctctcacagaacaaagagggagtcatgccatgtc
ccctgctcccacaaatgccccacccagaggggctaatgcctaggattgagggtcttgtgt
gctgaggaagtcctgtcccccaatccctacaaaagccagaaccagctactaaggggtta
gacacagacagaactgtctatattaacatttcctcctaaaaaacaacaggaatcctgggg
aaagaccactggcctgggactccatgagccctggcttctatctctggctttcaggtga
ccacaggcaagtcacctagcctccatggtctaggccctcctgcctgttgggtgggaatca
ttacatatcacaatcattacagctgaccttcagggaggct >IGR2144a
atattaacatttcctcctaaaaaacaacaggaatcctggggaaagaccactggcctggga
ctccatgagccctggcttctatctctggctttcaggtgaccacaggcaagtcacctag
cctccatggtctaggccctcctgcctgttgggtgggaatcattacatatcacaatcatta
cagctgaccttcagggaggctgtactctgggtcaggaattgtgttgggtgcattatcata
tttattctcacagcaccctttgcagtagctactattttcatacccattctcagatgagga
aactgtggaacaggctggttagggacatgcccaaagtgacaaacttagcaaaggtggac
ctggcactcagtaccacatctgttttccatgctcttaaccactgtaacatacagagccc
ttttacagagatcaaggacagaggtaaaagtgttttgaaagcaaaaaaaaaaagcgggg
aggatgcataaaataaacataaatcacccctgccccgcccagacataattcagggaaga TABLE 5-continued gtcctaaccccccaagaaccttctgtggaacttattcgcaacatcagagacctccaacata
gaaatgaccctcaataagtcatttctttcttcctctttcccttcaggcaggaataatata
actaactgaattatacaggtgagaccacgaaggtcaagca >IGR2145a
taaatcacccctgccccgcccagacataattcagggaagagtcctaaccccccaagaacc
ttctgtggaacttattcgcaacatcagagacctccaacatagaaatgaccctcaataagt
catttctttcttcctctttcccttcaggcaggaataatataactaactgaattatacagg
tgagaccacgaaggtcaagcaaggtgaccagcttaggcccctggctggcaggtaaggag
gagactgaccccagcctcctggctcctaggggaggaaacagtgatgacaaaggcccctt
gcatggccaaggtggagccctttctaccaaagtttaaacgttttagtataatatccaagt
gcatcttttccaaccttaaaaacatatttaatttccttataaagctggttggcactctcc
tcctcctccaaagctctgtattaggcagggttcatagttgtagacaacagaatgaacagt
ggttagttcagccagaaagggatgatataggaggatactggggttgatcaaaggctctct
gggagggctgcagatttagagccagtcagccaggaacgatgcctgaaacataccttagag
ctggagaaagaacaaaaccctacctttcttcaatagctggcaaggtggcaaggtctggcc
ccatgcagcctgggctcttcccactctcctctctccctaa >IGR2146a
gggatgatataggaggatactggggttgatcaaaggctctctgggagggctgcagatttag
agccagtcagccaggaacgatgcctgaaacataccttagagctggagaaagaacaaaacc
ctacctttcttcaatagctggcaaggtggcaaggtctggccccatgcagcctgggctctt
cccactctcctctctccctaatgcgttgccctactcgctgcttcccaggcaatcccacct
caggtctatgaacttgccattccctctgcctgcaacctagacattcacattgctagctcc
ctggctagctcaaatgccaggtttctgcacaaatgctcctccttagagaggccttcctgg
acctctaggtctctggccctagtactctatccctctccctgctttcctcttctacttca
ctgctccttaacattgtgttatacattgtctgtctcccaactggaatgtaagtggcacc
agggcagggacttgggttgttttgttccttgctgtaagcccagggcccagggccagacct
ggaacaattaggtgctaagttatttgctgaatattctatgaaggaatgacaaaggaatgc
ataaagaacttcaaagttcaactcctcgaacttcaaacttcaaatccccaactcctcctg
cctatgctggacgattagggcagtaacaggagtcaacttg >IGR2147a
ttttgttccttgctgtaagcccagggcccagggccagacctggaacaattaggtgctaag
ttatttgctgaatattctatgaaggaatgacaaaggaatgcataaagaacttcaaagttc
aactcctcgaacttcaaacttcaaatccccaactcctcctgcctatgctggacgattagg
gcagtaacaggagtcaacttgtgctgtgctgtcacctgcctggatccgcatcagccctg
cagctcccactttggaggagacttgcccagggacctacagctctgaagcttctctgacag
cctctgcagctcttggaacttatctgggctgctgctgtgcagaccatggatgcgtagctg
agttcctgcccctgatttcctagagtctcagaaagacagggaagtgacttacccaaagtc
cccttcaccctataaacagttcagcccagggagtgaggctgacacgcaaatgcagctat
gtatagactcagagtcatccaaggtcagggctgggtggagccttggtcacatgcaggcca
acctgtgtctggagataatgcaagccagtgcaggggttagcgtgtacatggactctggag
tctggcagatctaagccccacccaccaacctgtgaccttggagaattatttgaaaagaca
ttatttgaaaagcagatgtaaaatggaaataaaagttcct >IGR2148a
caaggtcagggctgggtggagccttggtcacatgcaggccaacctgtgtctggagataat
gcaagccagtgcaggggttagcgtgtacatggactctggagtctggcagatctaagcccc
acccaccaacctgtgaccttggagaattatttgaaaagacattatttgaaaagcagatgt
aaaatggaaataaaagttcctatttaaaacagtcagttgtccccccattcagaagcctatt
acagttgtccctcagcatcttcgaggaattggttccaggacagctcctcagataccaaaa
gccacgatgctcaaattccttataaaaagtgacgtagggctgggtacaatggctcgtgcc
tgtaatcccagcacttttgggaggaccgaggtgggcagctccacttgaggtcaggagttcaag
accagcctcgccaacatggtgaaacccccgtctcctctaaaaatacaaaaaataggcgggc
ttggtggcatgcacttgtagtcccagccactcgggaggctgaggcatgagaattgcatgg
atccgggaggcggaggttgcaataagccaagatcgcaccactgcactccagcctgggtga
cagagtgagacttcatctcaaaaacaaaaaacaaacaaacaaaaaatgtgtagcacagtc
agccctccgtatccacaggtccacacacagaacctgctgg >IGR2149a
gtcccagccactcgggaggctgaggcatgagaattgcatggatccgggaggcggaggttg
caataagccaagatcgcaccactgcactccagcctgggtgacagagtgagacttcatctc
aaaaacaaaaaacaaacaaacaaaaaatgtgtagcacagtcagccctccgtatccacagg
tccacacacagaacctgctggtatggagggccaaccgtgcttcctattctttttttttt
tctttgagacagagtctcactctgtcacccaggctggagtgcagtggcacaatcttggct
cactgcaagctccacctcccaggttcacgccattctcctgcctcagcctcctgagtagct
gggactacaggcacacgccaccatgcctggctaatttttttgtattttttagtagagaaggg
gtttcaccatgttagccacgatggtctccatctcctgacctcgtgatccacccgcctcgg
cctcccaaagtgctgggattacaggcgtgagccaccgcgcccggccacttcctattccttt
atggtatcaaattcaaactccttggcttgatagtcaaactctcaccacgactgaaatctg
gttaaccaacctgtccaatacaatctctctgcactcctccaaataatgttcaagttggac
ctaagtgctccctagtcctctcacacctgtgtgcctgga >IGR2150a
tacaggcgtgagccaccgcgcccggccacttcctattccttatggtatcaaattcaaact
ccttggcttgatagtcaaactctcaccacgactgaaatctggttaaccaacctgtccaat
acaatctctctgcactcctccaaataatgttcaagttggacctaagtgctccctagtcct
tctcacacctgtgtgcctggaaacaccaccccaccttcttttctctcatctgaatttacta TABLE 5-continued gagccccagaggcaggtctcatagtcttccctgacttgggttttttttggcactgactact
gggcattcatgatgggacctgccctgggctctagtatttggtgttacagggaggaaca
cagttttgattcccaaacagaacaaaggatccttgagggcaactgtctgttgtcatttc
atgtctcccccaaccaggcattaaaacacgcatagaaattcctgctgacgggctcttgtg
aagttacaagttacaattggtgaaaatgcccccaagtatttcctctatttcccaaggaa
aggaaaagaaagatatagaaattaaattaaagacaaacttaaatcattcccatttctgca
tgcttggtctgtgtgggaaaaaaaaatcatttcatctctgtctgcaacgcagacttgaca
agttgagaaactccctaaaaacaaagcatacaaaaaaaaa >IGR2151a
ggtgaaaatgccccaagtatttcctctatttcccaaggaaaggaaaagaaagatataga
aattaaattaaagacaaacttaaatcattcccatttctgcatgcttggtctgtgtgggaa
aaaaaaatcatttcatctctgtctgcaacgcagacttgacaagttgagaaactccctaaa
aacaaagcatacaaaaaaaaatcataccaattagtctcacttaaaggtttcaggaagga
aaacacagttaaactgaaaacggttaactggtgtttaaaaaaagaaaccagcccggaaa
tgttttaggactgcgtctatcgaagtcccttagggactgatttgtccttcaatatattc
atagcacctgctttcaccaaaacccagcagcccaacgctagagctttgtgagtgagatgc
agagtggaactggacatggagctacacagctctgaatcatgttcccaacagcaagcaac
agccacatgaaggattcctggcagtgccctctagccactacagtgggccatgggaagccg
tacaaacagcaaatggcatcctgcaaccccagcttctccttctgccgcattcctctctct
gtccatgcctctgcttcccattggcccactggccaaatacactcagaaaaaagtccatg
cacaagcctccacccaaattaattccacattcttcaaga >IGR2152a
ggcagtgccctctagccactacagtgggccatgggaagccgtacaaacagcaaatggcat
cctgcaaccccagcttctccttctgccgcattcctctctctgtccatgcctctgcttccc
cattggcccactggccaaatacactcagaaaaaagtccatgcacaagcctccacccaaat
taattccacattctttcaagagaggccttgaaaggtactgaaattcagggaagctcttca
ctagacccctcactggaatgccaagaagtgatgtagtggccctttgacataagggcttatt
cccatttatgaaactgaaattatttattctaagcacaaagctaacaaatgtgatcaaaa
cagaaaataaacaatcctcattcaagtgctcagaatgcagcacaaataggatcttgggat
aaataagatagctgtgaaattaataggggtgagaagagggggagggtcagcgggagaag
tccaccaaggggctgaaaggcctgtgcaggcagacggaaaccctgggttcttaggggcca
ggcatgacagtgcagaatagtccaccctgggagtgactggaagaaggactgcagggtccc
cgtgaagaacacctcacactcccagcttgccacacacttgttgaactattctgggtggat
acctcctacctggatggcaaaggagacaggcccaagatgc >IGR2153a
gcctgtgcaggcagacggaaaccctgggttcttaggggccaggcatgacagtgcagaata
gtccaccctgggagtgactggaagaaggactgcagggtccccgtgaagaacacctcacac
tcccagcttgccacacacttgttgaactattctgggtggatacctcctacctggatggca
aaggagacaggcccaagatgcagaagggaagggaagtcacacttacaatgcagaggatgc
gcccttgtccctcatactctctgaaacattgcaggaataattctggtttcactgctattg
tttgttgtttttgtaaataaaccgcaaaaatcaacaaatggcctcaaaattgaacacatg
tgatttacaccaattcatatatcaaaacacaaataatgcagaacaaattagagaaaact
ccagtcaggctctccactcacccatggctggtggctggcattcaactctccagcagccag
ggagtccatttcttgtttctctgctggccatcctcaggacttgcggcggggagtgggggg
gcccagggtgtgctgccacctgcaggccaaacaaggaaaaaacataagcaacggccacaa
tcatccgcctgaagcccctcctatatcctcaggccgctggaagacctggatgcccgtcgt
gggacaagagccagaagcactcacccagtgccaacacctg >IGR2154a
ctctgctggccatcctcaggacttgcggcggggagtgggggcccagggtgtgctgccac
ctgcaggccaaacaaggaaaaaacataagcaacggccacaatccgcctgaagcccct
cctatatcctcaggccgctggaagacctggatgcccgtcgtgggacaagagccagaagca
ctcacccagtgccaacacctgctgggccacaaacagtttctgcttgggatcccaacacag
gcagcagagtcagcaaaaactctaagatatcaagaagtcaagcatttcttaacaacagca
gcaaactcttacacagggctgtggttaccagacactgctctaaataacttacacttgttt
acttatttcatcctcacaacaacgggtaaatattttaggtctctgccaatttgcctgatt
actgaattaggttgaatcattaaaatgaataacttgataatacccaatttcaaagagggg
tcacatatgaaaactctatgagagattctcagcatcttgcagacattcattccctaaata
ttcattgagtgtttgttatggacgagacactgttctaggacctgggaagagaggagcgaa
cacacaagacaaagtccctgttctcacgaagcttctgttccagtgcggggaggcaacagt
agaaaaggagacaaatgccatgcagaagaaaaagcaggga >IGR2155a
gagagattctcagcatcttgcagacattcattccctaaatattcattgagtgtttgttat
ggacgagacactgttctaggacctgggaagagaggagcgaacacacaagacaaagtccct
gttctcacgaagcttctgttccagtgcggggaggcaacagtagaaaaggagacaaatgcc
atgcagaagaaaaagcaggaaaaagagatagagcacaatgacaatgctgttaatacccca
ttcatttattcacttattccaaggacttactaaccatgtcatttcttgcccacagctgc
atgccaggcactatgccagataaaattgtgggtaagaaatagacatggtctctgcctgta
tggagtacttacataagaggaacatctattattagtcaaataatcacctaaataaatgca
aagatgttaatctgataggtgtgatagcagaattgcatgtagtccttgtgagagcatc
tcaaggaggcctgaccttgtcaagggaggcctgaaatggatgtggggaggagcaatg
tgttagtccattttgcattgctataaaggaatatctgaggctgggtaatttataaagaaa
agaggtttaaggcggggtgcagtggctcacacctgtaatcccagtactttgggaggctga
ggcaggtggatcatctgaggtcaggagttcgggaccaacc TABLE 5-continued >IGR2156a
tctaagggggaggcctgaaatggagtgtggggaggagcaatgtgttagtccattttgcatt
gctataaaggaatatctgaggctgggtaatttataaagaaaagaggtttaaggcggggtg
cagtggctcacacctgtaatcccagtactttgggaggctgaggcaggtggatcatctgag
gtcaggagttcgggaccaacctggccaacatggtgaaacctgtcgctactaaaaacaca
aaaattagctgggtgtggtggtgcacgcctgtaatcccagctactgggaggctgaggca
gaagaattgcttgaactggagaggctgaggttgcagtgagccaagatcgtgccaccgcac
tccagcctgggtgacagagcgagaatccgtctcaaaaaaagaaaaagaaaagaaaagagg
tttggctcacagttctgtagactgtacaagtgtggcaccagcatctgcttggcttctggt
caggcctcaggatgctcacaatcatggtgaaaggtaaaggggagctggcatgtcacatg
gcacaagaaggagcaagaaaggggaggaggtgccaagcctcctttaaacaaccagctctc
gcctgaacagagtaagaactcactcattacctcggggagggcaccaaaccattcatgagg
gatccagccccatgacccaaacacctcccaccaggcccca >IGR2157a
aatcatggtgaaaggtaaaggggggagctggcatgtcacatggcacaagaaggagcaagaa
aggggaggaggtgccaagcctcctttaaacaaccagctctcgcctgaacagagtaagaac
tcactcattacctcggggagggcaccaaaccattcatgagggatccagccccatgaccca
aacacctcccaccaggcccacctccaatgctggcgatcacatttcaacatgagatttgg
aagagacatgcatccaaaccatatcaagcagtgtccctgtcaaaagcacaccctgtgcac
aggctggatcatggtagttggcagggacaggaggcagggtgaagctggagaagcagtgt
aggtgacccttgcatgacactcccagccacaagaggagttcgagcctaaccctggagaa
ctggagcaccacacaagggtcttaggcagaggattaatgcatttagatgtgtacttttaa
aagattatctatgtaggctgagtaatggccctgccaaagatgtctatgtgtgaatccctg
gaggttgtgtgtatgttccctatatggcataagggacattgcaaatgtgatcgagttaa
gggtcctgagaaccggagattatccaggtgggcccaacataatcacaagtgtccttataa
gagggaggcaggggggagatctgacttcagatgaggagcct >IGR2158a
gagtaatggccctgccaaagatgtctatgtgtgaatccctggaggttgtgtgtatgttcc
cctatatggcataagggacattgcaaatgtgatcgagttaagggtcctgagaaccggaga
ttatccaggtgggcccaacataatcacaagtgtccttataagagggaggcaggggggagat
ctgacttcagatgaggagcctcagaatgatgtggcacgagaaagacttggcttcgaagag
gaggaagggcccctgagccagggaatgcagtggcctctagaagctggaaaaagcaacaaa
acgattctcctctagagcctccagaaggaacgcagccctgccaaagccttaatttcagga
cttctaaaagagtaaatttgtgttgtttaaggcactgattttgtggtaatttgttacag
cagcaataggagaataggacatactagctcctgtaaaaaaccagactggacgtaagggcg
aggcgaggcagggaccagctagaggtcactgctgtggtccaggcaagaggtgtgagagct
tgcaccacagtggtggccgtggggatggagaggagtggtgcagttgaaggacccccagcag
gggaagagctgaccagtcaaaggtctcgctgcaatctggcagatgttactggaatgccac
aacaggcctcttttcaggctcaggccctggctggctcaccc >IGR2159a
tagaggtcactgctgtggtccaggcaagaggtgtgagagcttgcaccacagtggtggccg
tggggatggagaggagtggtgcagttgaaggacccccagcaggggaagagctgaccagtca
aaggtctcgctgcaatctggcagatgttactggaatgccacaacaggcctcttttcaggct
caggccctggctggctcaccctggctacagcccagcagctttacagaaggaggaagctca
caccagggctgtagaccactcccaggcagatgcaccatttactcacttaacctgccaacc
ccattcccacaaaaaagttcaagagtctccaggaacaagccctaagaaagaacacgtggg
gaatttttactaggcaaaaggtagcaattatttctgccaagcattaagccttgcagcgaa
cttttttttttttttccgtgaacagagattttgtaattctggaagagaggtgtccagattt
aaatatacacatctccaacacaggtgatacagaaccatgattaaatctaacatctaaaaa
cttcatggtcagcagaaaatgcagaaattaaagaaagactaaacaagaaactaggagact
cagcgtctactctattcttgcttaataatccagacctacttaaaaaatgggatcctaatt
tggtcctgtttaatggagctgtcaagaagaaaaagcaata >IGR2160a
acaggtgatacagaaccatgattaaatctaacatctaaaaacttcatggtcagcagaaaa
tgcagaaattaaagaaagactaaacaagaaactaggagactcagcgtctactctattctt
gcttaataatccagacctacttaaaaaatgggatcctaatttggtcctgtttaatggagc
tgtcaagaagaaaaagcaataaaaattattcgagagaattttagaaacattctcccattc
tactccaaaaatataaatatgcacactccaaaaccaagtaccttggactgtactgagaga
tgacaatgacgtcttaaccgtactatttccccatgatgttgcagcaggccacagggacct
aactgaattgtaagaacatgaaaggacccaggaatgcctgcagatgacaaaataccaggt
agtcctgtcagtgtaggagcatgttaatttaaaaatagatatattttctggtgacaaaa
gtgacatgtctattactggaaaacacaaacaactcctgtagtccaatgatccagagataa
cccatttggaaatattttcttccagtcttttttccccattgatttcggcacaggcgcgcg
cacacacacacacacacacacacacacacactcatacttcatttttaacaaaatta
caatactgtatatacttttataaccagttttatataacag >IGR2161a
aaaacacaaacaactcctgtagtccaatgatccagagataacccatttggaaatattttc
ttccagtcttttttccccattgatttcggcacaggcgcgcgcacacacacacacacacac
acacacacacacacactcatacttcatttttaacaaaattacaatactgtatatactttt
ataaccagttttatataacagtatataatcctccatgtattaaatacagttttttcataat
gctagtattccatcatatgaaagtaggaaaatcacttaaccaatccctaattgctgaaca
actgagtagtttctaactttatggtaacataagtcattgggaggaacctcctcatctacg
ggaatatccctagatataaatctatgtctatagctctgattatttccttagggtcctatt
tcctacatccatgcattgccattactattttgctataattaattaccatctgtaatgtac TABLE 5-continued ttaacatttctctttacatcaactcatttctgtccttaaacaaatgtattttaaaagcaa
acctgactcggtgtagtggctcacacctgtaatcctagcactttgggaaaacaaggcagg
cggattgcctgagctcaagagttcaagaccagcctgggcaacatggcgaaacccgtctg
tactaaaaatacaaaaaatcagccgggtgtggtggtgcgt >IGR2162a
caactcatttctgtccttaaacaaatgtattttaaaagcaaacctgactcggtgtagtgg
ctcacacctgtaatcctagcactttgggaaaacaaggcaggcggattgcctgagctcaag
agttcaagaccagcctgggcaacatggcgaaacccgtctgtactaaaaatacaaaaaat
cagccgggtgtggtggtgcgtgcctgtagtcccagctactcaagaggctgaggcacaaga
atcgcttgaacctatgaagcagaagttgcagtgagccaagatcatgccactgcactctag
cctggacaacaggacaagactctgtctcaaaaaacaaacaaacaaacaaacaaaccttat
ttaagtggaaaaccaacatcatatgccataaatgaaggcaatcataataggttttattgg
aataaaaaaacactgtggttaaaatatagtcaaaatactgctacccctttgcccattctt
ttatataaaatgggagattagagaggcttagagaggtgttaaaggtatgctagcaccaag
ctaaagttttttcaccttccgttgatcagaagactgaaaaggaattgagcatgggaataac
tttctcactgtgagtcagtgttagacaatgtggcaaatgtgtcccaactagaattaccct
gcgccacctgaaataacctcatatgaaaacatgccttagg >IGR2163a
agagaggcttagagaggtgttaaaggtatgctagcaccaagctaaagttttttcaccttcc
gttgatcagaagactgaaaaggaattgagcatgggaataactttctcactgtgagtcagt
gttagacaatgtggcaaatgtgtcccaactagaattaccctgcgccacctgaaataacct
catatgaaaacatgccttaggacatattcctggaagtagaactgggataaaaggcatgga
cactttaagcagcttctgataaccacagcccaaacaccatccaagttagttttaccacag
ttttactatgactgtgtccatttacttcacgttcacaaatattaagtactataaacaaa
atattaaaatagttaaaacgtttcagcttttttgatgtaaaatatccagcagctgaatctt
caaaggctattttcatgctcttctagctagtccctgaccctaggcagggctattttatg
aacctttaattagtggtaagcttacaacaaactgatactgcacttggtttcaccaagctg
aagtaaactctgtaaaagatgaggaagtgactttagcatttgcaaatatttcagaatgcc
tttgtgccagcaaaggtcaaacaacgatcagaattgcatggattccaaagtatactttg
ggaaataagagactcagagaagcattactcaagatacaat >IGR2164a
gcttacaacaaactgatactgcacttggtttcaccaagctgaagtaaactctgtaaaaga
tgaggaagtgactttagcatttgcaaatatttcagaatgcctttgtgccagcaaaggtca
aacaacgatcagaattgcatggattccaaagtatactttggaaataagagactcagag
aagcattactcaagatacaattcactatgaattttcagcaattcaatgaaaagtctaaaa
gaaatacatgtttaaactttcctatcctggtataatatgcaattgcacaaataggttaga
ttgtagattaatgcaattgttaatatttctaacatagaaaaggaaattgtattttgaag
caagaagaattaataacaattggaattgttcaggttattttaataattcccaggcagata
cctatgtgtatatgtgcctgtggggaaaaggtaaggaaaaagagacgtgagaaaacatac
ttatgtaattccagcactttgggaggctgaggcgggtggatcactaggtcaagagattga
gaccatcctggccaacatggtgaaaccccgtctctgctaaaaatacaaaaattagctggg
catggtgggacctgtagtcccagctactcgggaggctgagacaggtgaagtgcttgagcc
cggggaggtggaggttgcagagagctgagattgtaccactg >IGR2165a
tgggaggctgaggcgggtggatcactaggtcaagagattgagaccatcctggccaacatg
gtgaaaccccgtctctgctaaaaatacaaaaattagctggcatggtgggacctgtagtc
ccagctactcgggaggctgagacaggtgaagtgcttgagcccggggaggtggaggttgcag
agagctgagattgtaccactgcactccagcctgggtgacagagcgagactccatctcaaa
aacaaaaacaaaaacaaaaaataaaaaaaaagatttattatgtttggaaggaggttatag
gttctgattaattttttgccagagacaaaaatacaagtttatctaagcttaagaactaaat
gatggcctattgtaagatatagaacttccaactcactgaataaaaagaaggaaagaagaa
acaggggacaaatacactttgatgaatccatagagtcacaaggaaaaaaaaaacacacat
gataaatacatggcaaaacaagatggcaaaaataagaccacatttatcagtgatcaaaat
aaatatgaatgaattaaattccattgttaaaagaccaagactttcaccctaaatgcccat
aaatggaaatggataaattatggtatgtattccattttaatggatgtgtatgtgtgtgt
atgtatgtgtatgtgtgtatacaccacagaaagaggcc >IGR2166a
aagatggcaaaaataagaccacatttatcagtgatcaaaataaatatgaatgaattaaat
tccattgttaaaagaccaagactttcaccctaaatgcccataaatggaaatggataaat
tatggtatgtattccattttaatggatgtgtatgtgtgtatgtatgtgtatgtgtgtg
tatacaccacagaaagaggcccatgagtttcagtttagaaagatgtagaaatatatttgt
ataagcataggaaagggtccagaaaaacacaccaatatgatatctgtggttgcctataaa
gagcagtttacctatgagtttcagtttagaaagtgtagaaaaatatttgtataagcata
ggaaagggtccagaaaaacacaccaatatgatatctgtggttgcctatggagctgaagt
ggactttcctgtctcactttacaaatgtctatactgtttgaatttattacaaaagcatat
gactaaagaaacatgaaaaaatggaataatcaaacataagggcagaatcagcaaaatagag
gacatagaggaccaaaaaaaggtggttaacaaaacttgaagtatttatttgaaagtaga
caaacctctagtgagactgatcaagaataactgacagaagattttttaaaaatgagatta
cagaaaaaggaagaaatgacaaatataaacagacatttaa >IGR2167a
aatggaataatcaaacataagggcagaatcagcaaaatagaggacatagaggaccaaaaaa
aaggtggttaacaaaacttgaagtatttatttgaaagtagacaaacctctagtgagactg
atcaagaataactgacagaagattttttaaaaatgagattacagaaaaaggaagaaatga TABLE 5-continued caaataaaacagacattttaaaacttataaaggaataatataaacacatgataatacatt
tgaaaatacagatgaaatgaataatttctagacaataaaaattgccaaatttggcacaaa
aatgtgaataaccacttaagagactcaaataattttgaaacctcttccccatagagtttc
agacccagaagattttacaagtgcctcctactaacttccaaggagcagaaaatctctatc
ttaatggagttgctttagaaaatagaaaaaaagagaaaacattgcccaatttgttacttg
attttgaaatgttaaatatggactgtacaaataaagaaaaatacaggatagtttcactta
taaacatagatgttaaactcctaaataaaatattatctaatcaaatacgaaagtgtatta
caaatacatcatgataaagtaattcaccacattagtcgattgtggaagaggttactagtg
ctcaccagtctctcgttcttttcctcctgggaacaccacc >IGR2168a
ggactgtacaaataaagaaaaatacaggatagtttcacttataaacatagatgttaaact
cctaaataaaatattatctaatcaaatacgaaagtgtattacaaatacatcatgataaag
taattcaccacattagtcgattgtggaagaggttactagtgctcaccagtctctcgttct
tttcctcctgggaacaccaccaggctacatttcccagccaccttacaattaggtgagacc
catgagactagtccatgccaatggaatgtgaatggaagtgcatctaattttctggctcat
gaaaacagcagcattttctctatttttcttttttctttctttgttttttttagacggagt
ttagctcttgttgccgaggctggagtgcagtggcgcgatcttggctcactgcaacctccg
cctcccgggttcaagcaattctcctacctcagcctcccaagtagctgggattacaggcat
gtgccacaatgcctggctaattttgtattttagtagagacgggtttctccatgtttgt
caggctggtctcaaactcccgacctcaggtaatcagcccgcctcggcctcctgaagtgct
gggattacaggcgtgagccaccgtgcccggcaagagcagcattttctaaaagcaatcagt
actcaacaccatcctgctgaggtagggcagcggcggactc >IGR2169a
attttgtattttagtagagacgggtttctccatgtttgtcaggctggtctcaaactcc
cgacctcaggtaatcagcccgcctcggcctcctgaagtgctgggattacaggcgtgagcc
accgtgcccggcaagagcagcattttctaaaagcaatcagtactcaacaccatcctgctg
aggtagggcagcggcggactccatgttttgaaacttaggaacttagaccatctttttgtca
aattcagatggttttctcaaagtaaagatcattcaagttttgtttcagtaatgggccgta
tgatcagatctgtgtgattaggctgaattcattattattgagacaaaaattgagttaaag
gggattcttggtattggcctgcaaaacctgtcataacttaaatgtaaagtttctgatgat
ttagtcactttactctcagctcttagctctttcactcacctgtccttgttctacacaacc
tgcctgatgggtaacttgaatacatattttctctcttcaggggatgggaacgccctaagg
gcaggggctgtttccacagccctgggtggaaccccttcctgcataccaagaatgagtt
ggctatacttgacgaagggcaaagacaaggtggcacgcatctttcatgcttctgctggca
gatgcagtggactggaaatttcctggtctgggaaggactc >IGR2170a
atacatattttctctcttcaggggatgggaacgccctaagggcaggggctgtttccacag
ccctgggtggaaccccttcctgcataccaagaatgagttggctatacttgacgaaggg
caaagacaaggtggcacgcatctttcatgcttctgctggcagatgcagtggactggaaat
ttcctggtctgggaaggactcggtctgtgagtgcacctatccctgacatctatgctagcc
ccgggatgggggccccagcagagtaaggccctgacttcacatggacagggccagggcaag
ggggccacatcctggcctagttgctctccatgcccgtgatcaaggggagatgagctgccag
cttgctcggtcaaggaacacttggaaggcactccaagtgccccaggtgccaccagatcta
ggaaacttaagcaaactacatgaggtatgggtggggcccagtgggaaaaatgagtctga
caggtcagagggagtagattatgagctcaggttaggcattctgttcagcattttacgtac
accctcccacttttgattttaccaacacccagggaggtcggtgctctacaaaagggaaa
ggcgtgctcaggtggcccgacttgccacggttccagctcgaccccgggctgctagccct
tggcacgcttgtctgaggcctcccaggtcttccagcctgg >IGR2171a
tatgagctcaggttaggcattctgttcagcattttacgtacaccctcccacttttgattt
ttaccaacacccagggaggtcggtgctctacaaaagggaaaggcgtgctcaggtggcccg
acttgccacggttccagctcgaccccgggctgctagcccttggcacgcttgtctgaggc
ctcccaggtcttccagcctggcctggaggctcaaagccacgaaacccaagggtgccgctt
ctcaggccctccccgccccacggcagaaccccctgaccctgcccgggtcaaacgcctggc
gtcgggcccgccgggtccgcaaggaggagcccgcgaggcggccgcgaaggggctgtgctt
acctcgcccggcgcgggttgcggcccagggcccgcgctccaggctggcggccgctgcat
tctgcgcccctcgcctgaaacggcagctgcgccagtcctggccacgaccgctttcatttt
cctcaacgacatcggcaggaaagcgaaagcgaaaccctccgggagcggggacccgggccg
agcgcgcagtgaacgcggggcgcgcggcgggcgcggggccgcagccagaggcgggggccc
cgggctcgggtctgcgcgtggcctggcccggtggcgttcggggtggagctgggccagccg
agtgcccgagagctagtccgccacgcacacctgcctcggc >IGR2172a
aaagcgaaagcgaaaccctccgggaggcgggaccggggccgagcgcgcagtgaacgcggg
gcgcgcggcgggcgcgggccggcagccagaggcgggggcccgggctcgggtctgcgcgt
ggcctggcccggtggcgttcggggtggagctgggccagccgagtgcccgagagctagtcc
gccacgcacacctgcctcggcggggacccgggccgggctgggcgggaggctgggcaggcc
cgccgtaagtggaaaggcgcccgcggcgcttcggccgaccgggacaggttcctccatctg
cccttcattcagcgtttacttgggcctgtggctggcagccggcccgggacctgaccgctg
gcggcgcctcgggctctggcctgaggaggcagatggcagcctgagcaactgggaccaagc
ctctgaggagtcccgttggagggacttgaccatgaggtaccaggcatctcatctgggg
tcagcggagaacccaaaagtcaatgacgtcggtgaaatgggggtcccttcatccgataag
agaaactggaacagcaagcctatggtttgactccctggtctaagcggtgcccatcaata
tctaaacatttagagattccaggtttcagtgtctggccgtctcttactgtcagtgatttg
gggcaaaatattcaagtagttagacttaattacttcccct TABLE 5-continued >IGR2173a
tcaatgacgtcggtgaaatgggggtcccttcatccgataagagaaactggaacagcaagc
ctatggtttggactccctggtctaagcggtgcccatcaatatctaaacatttagagattc
caggtttcagtgtctggccgtctcttactgtcagtgatttggggcaaaatattcaagtag
ttagacttaattacttcccctgtgggatgggaataataataatcatacctactgccagaa
ttttaggaatgaacaatagaaggaagaaaatacttaaaattttctgacagcctctaagtg
ggttccttgagggcagcaaccaagtcatttacctggatgcttgatagacattctctaatg
gccagtccatcaacttggagctatctccatgataacaggttagttgtcaaagtttggaca
atattatctggagtttaaagactgaggaagccctgcaatttttttttggaaggtgtctgaa
acttagcctgacaattagccccacaattatgccacggaaccaggttttttgttagagtgg
agcatggccacaacgtttgatggacattcctacagcggtgttcagcgctggccactgagg
tctgaaaatacttttgcaagcatttctattcacttgcttttagaaaacattggtaagaca
ccatactccaaacacagtttgccctgtctgtacgtttgtt >IGR2174a
ccccacaattatgccacggaaccaggttttttgttagagtggagcatggccacaacgtttg
atggacattcctacagcggtgttcagcgctggccactgaggtctgaaaatacttttgcaa
gcatttctattcacttgcttttagaaaacattggtaagacaccatactccaaacacagtt
tgccctgtctgtacgtttgttgcaaagcaaacataaaagttttttgccatagagcaaacac
agagcagtctgttataactggaacaagaaaccaaaatgagctattaaatctgcccagagt
cactttggtttacctgtttgtaatttgggcacattccctgcaagatggaggccctggtct
gtgactgatgtaggggcttgtatgtgtccttgcaatagttccctcaagagcaggtgggaa
agtggggcaggccaaatgatgaccttagaaaaacaacagcctgtttctcgtgtccagaaga
tgctacttttagtctgtagtatgaaggaaaaagaaaaaacaaaaaaggcaagccttggag
cctcttcctccttataggacaattcttgactccaagatagcaaagtagagttaaatctgc
ttctgcataaaaactatgtttgggaagatgaagatcaggaaaagacaggaagagatgtaa
gcagataagccaaatcctggttacctttttatagacatcac >IGR2175a
tatgaaggaaaaagaaaaaacaaaaaaggcaagccttggagcctcttcctccttatagga
caattcttgactccaagatagcaaagtagagttaaatctgcttctgcataaaaactatgt
ttgggaagatgaagatcaggaaaagacaggaagagatgtaagcagataagccaaatcctg
gttacctttttatagacatcacacatgtgaacagagagcatcaggaggtcaaggccggcct
gatgttttcatcttggcaacttcccaaggtccaggtttggtccttgactttgtggggcc
aaaaatctcgtctgacttccagtgtaccagagtcgattagcactgttgcataaagtcaga
atgcaactgactgatttcattcactatttgctagagaagtgctatgctaaatgcattac
atgcattattacctcattatttctccctactatcatgtggtatattataatctatttatt
tttcatttgggagaaaaaaagatgaaggaaatcccaaggtcacatggttactatgtatgt
tagtggcagggtttgaatcaaggccatctgaccccaaaacctgaagcttatccattcctg
ttagaagcaagactgtcgggaacactggactcgaggccacctgatgaacacattctcttc
ttgtagccatgcagtttggagccccatagtcagaaggtgg >IGR2176a
agatgaaggaaatcccaaggtcacatggttactatgtatgttagtggcagggtttgaatc
aaggccatctgaccccaaaacctgaagcttatccattcctgttagaagcaagactgtcgg
gaacactggactcgaggccacctgatgaacacattctcttcttgtagccatgcagtttgg
agccccatagtcagaaggtggcttagtgagcctaaaatcagaatcggaagagtgaattgt
ctgacttaaatgtttgatgatatcaggctcgggcaatgtgggatgtctctttccacaaca
caggtcaaaacctataggaagtactgttcactcatccctgctggcctggccagccccttct
ccctagatggggcctggttggacaccatctgtttgtgtcaatgaggctctctgtattatgg
tacccaggccgcctctcctcagatggacatttttagatagagcaaggcgttactgagtaa
cattactcagtaaggtctcgcagcccttatttttcttatggagacattttgtatctttg
ctctgattggcttgatttataatttaacttctaaaggacagcttctatcccacctttg
gagacagctctgttttccttactatccttcctgatctaaccctggaacaaaagtttgtgc
agtagcaagttctgcaacaagaactttatccaggcctgca >IGR2177a
gcagcccttattttctttatggagacattttgtatctttgctctgattggcttgattta
taatttaacttctaaaggacagctttctatcccaccttttggagacagctctgttttcct
tactatccttcctgatctaaccctggaacaaaagtttgtgcagtagcaagttctgcaaca
agaactttatccaggcctgcactgatagtcagtaaagacacaaaagaagcaaaagtccaa
gtccaaggccagtcccaaaagactttactacagaatcggcaatggaggggttggggggcg
gggcacagctgatgatcacgcaaccccagctgaagaatgatataaatggaatgaaagcatg
gtgcaagcagcatctaacttaggagtcactggttaggaaaaaaaaatacctgatgtgtga
ttcagataaaaatgaaaaaaataacccttttagatatttcattcaacaaatattctgtgg
caactacaaaatgcagccaccctgctaatgctggggattcagtgatgagcaaaaataaat
gtggtctctgccctcgggaaacacacttgagtgaggtaataaagcaatcaaataattggt
caaatatagaatgccatcctaaatactacaagatgcgtttgacgctataagagggaatgc
cagaggcaaaactcctctaatgggccacctgtactctggg >IGR2178a
ccctgctaatgctggggattcagtgatgagcaaaaataaatgtggtctctgccctcggga
aacacacttgagtgaggtaataaagcaatcaaataattggtcaaatatagaatgccatcc
taaatactacaagatgcgtttgacgctataagagggaatgccagaggcaaaactcctcta
atgggccacctgtactctgggcttcctgtcagtctggccagcacttctcagaatggct
ctgcagtctgaggctcttcctatctactcctccatccttccctcttctcttcacagggg
tcagacctgcattacggtgtgggctctctctgcttactcttgcttctgctcctctttat
tcttcataggcattttccccaataaactcttccaggtttaattccatcttggtgtctgct TABLE 5-continued ctaggaggacccaagctgacacaatgatgcccttcattgacttggagaaccttggaagag
gcccaagttttggagggctccaattctgcacatgttggcttaggtgtcaggtgggcaagg
aagctccatatctgctttcccactcagaagataatgcttgtgctttggtactaagctatc
aaccatgtcctctgtgggagctagggtctggtcttgtttttaaaatgcttgttccatgga
taatcagcaattctcagtttagatctcaatactagaacta >IGR2179a
ccaattctgcacatgttggcttaggtgtcaggtgggcaaggaagctccatatctgctttc
ccactcagaagataatgcttgtgctttggtactaagctatcaaccatgtcctctgtggga
gctagggtctggtcttgtttttaaaatgcttgttccatggataatcagcaattctcagtt
tagatctcaatactagaactatttccctctagaaaagcacaacctaccaatagcaaaaaa
catcccttaacttccttgaggaggagttaaaagtcaaaaaatcgaaaggagatgagcaat
tgttcctgaacagccaaagggaaataattttgatgtagggggggcccttagttttctggga
aaaggaagtcttttttttttttttttttttgagatggagttttgctcttgttcccagg
ctggaatgtgatggtgtggtcttggctcactacaatctctgcctccaggttcaagtgat
tcttctacctcagcctcccaagtagctgggattacaggcacccgccaccacacctggcta
atttttgtattttagtagagacagggtttccttatgttggccaagctggtggcgaactc
cagacctcaggtgatccacccacctcagcctcccaaagtgctgggattacaggtgtgagt
cactgcacccggcctggaagtcatctttttataagtgttcc >IGR2180a
aagtagctgggattacaggcacccgccaccacacctggctaattttgtattttagtag
agacagggtttccttatgttggccaagctggtggcgaactccagacctcaggtgatccac
ccacctcagcctcccaaagtgctgggattacaggtgtgagtcactgcacccggcctggaa
gtcatcttttataagtgttccttaaggaaagaacttacatgttttggcagcacagatgaa
atctgtcattgttggtagaaagaagctagcactccaaaaggcacttttgctctgagctta
gcctccctgagcaaggtgccttggagagctgggtgtcaaggatgaccctgtcactgag
gttcagtcaccagcaacctgttgtgagtgaatcatctgtttgaaggcagagctcttcagg
tccaccgctggttcttcccatggaaggaggcttgaacacaaatcatgagtactacatgaa
tatttgaacgtggcactcagtcatagtcaagtatagcatttccctccaactgcacacc
ccagggagcccatatccatctcatggtggtgtggaggctgacagtaggcgagtttacatg
ctttgttcccaagctgtcaggaagcccagatactattagtctgcttggtctaaaaagaga
aagaagtaggtgtgggcttcatgaaggatgttttgctgag >IGR2181a
gtcatagtcaagtatagcatttccctccaactgcacaccccagggagcccatatccat
ctcatggtggtgtggaggctgacagtaggcgagtttacatgctttgttcccaagctgtca
ggaagcccagatactattagtctgcttggtctaaaaagagaaagaagtaggtgtgggctt
catgaaggatgttttgctgagggctgtgtctctcattcaaggatgaatgagtaaaagcat
ttgttaagttttttttttttaaaactaccaaatgtacagtgagtgtactacttaagcacc
ttagggataagcctgtcttttccgccaaaggtagttacaatttccctcatggaaccaagc
ataatatgataaggactaatttattttgtagagtcaataattacattataatttacacgcat
gatctaatttaatctttatagaaacctgatataggtaaggaattttacagttgaggaaac
agtctcaggaaagtaagtgacttccccaaagttatagagctagtaagtgaagacatcta
cttttggaccatatactttatctactctggatctgggcacttagccaaagccatagtgcc
tccaagaaagaggatgtcatgggtaaaccttgaacatgaatagaattgggataatcaga
gatgaagcaggacaacgtatggatggaggcaggagtgtca >IGR2182a
gacttcccccaaagttatagagctagtaagtgaagacatctacttttggaccatatacttt
atctactctggatctgggcacttagccaaagccatagtgcctccaagaaagaggatgtca
tgggtaaaccttgaacatgaatagaattgggataatcagagatgaagcaggacaacgta
tggatggaggcaggagtgtcaaggagaaatagagagctaaaagtgtgtcatatcaggagt
tgaaatgcattaaaaatatgtgaagtttggaccctttttatcgtaatataatgaccttctt
tgtcttgttaaaatctatttgtctgatattaatacagccattcaaactctcttttggtta
tttgtatggaagatctttccaaccttttaattttcaacctatttgtgtctttgaatctaa
attgaaactgttgtagacatcataatagttgcatcatgattttaaaatctatttggtgaa
tctctgccttttaattgaagagttacatttaatataattactgtgaaaagggcttactcctg
ccatttgctatttgttttctatgtcttttatcttttttgctcctcaattccttcattac
tgctttcttttgtgttaaatccatatttctaggataattctaaatctgtatcttttttaa
agtatatattatttattttcttaataattgccctag >IGR2183a
gagttacatttaatataattactgaaaagggcttactcctgccattttgctatttgtttt
ctatgtcttttatcttttttgctcctcaattccttcattactgctttcttttgtgttaaa
tccatatttctaggataattctaaatctgtatcttttttaaagtatatattatttattta
ttttcttaataattgccctagagattacagttcatatattaatttgtaacaacctggttt
agattaataccaagttaatttcaataatatgcaaacactttgttcttattcagctctact
ccctttatattatatttccacaaattacatctttacacattgtatgcccatcaacctaaa
ttttttaattattgctttatgcagttgtcttttaaaattatgtaggaaaagagaggttagg
aaaaaaattaatactgccctttatatttacttaggtagctacctctccccatgttcatta
ttccttcatgcagattcaagtattcaagtactggccagtgtcctttcattttagcctga
agactcccttagcattttttttttttttgagatggagtctccttgttctgttgtcca
ggctggagtgcagtggcacaatctcagctcactgcaacctctgcctcccaagttccagtg
attctcgtgcctcagcctcccaagtagctgggattacaga >IGR2184a
gtattcaagttactggccagtgtcctttcattttagcctgaaagactcccttagcattt
tttttttttttttgagatggagtctccttgttctgttgtccaggctggagtgcagtggcac TABLE 5-continued aatctcagctcactgcaacctctgcctcccaagttccagtgattctcgtgcctcagcctc
ccaagtagctgggattacagacatgtgccaccagcctggctaattttttgtattttagta
gaggcagagtttcaccatattgaccaggctggtctcaaactccaaacctcaggtgatctg
cccaccttggcctcccaaagtgctgggattacaggcatgagccactgtgcctggccctt
agcatattttttttaagtactttaagttctagggtacatgtatacaatgtgcaggtttgtt
acataggtatacatgtgccatgttggtttgctgcacccatcaacttgtcatttacattag
atatttctcctaatgctaccctccctcagcctccaccccctgacaggccctggtgtgt
aatgttccctgccctgtatccatgtgttctcattgttcaattcccacctatgagtgagac
catgtggtgtttggttttctgtcgttgtgagagtttgctgagaatgatggtttccagcct
atccatgtcctgcaaaggacatgaactcatccttttta >IGR2185a
ccctccctcagcctccaccccctgacaggccctggtgtgtaatgttccctgccctgtat
ccatgtgttctcattgttcaattcccacctatgagtgagaccatgtggtgtttggttttc
tgtcgttgtgagagtttgctgagaatgatggtttccagcctatccatgtcctgcaaagg
acatgaactcatccttttttatggctgcatagtattccatggtgtatatgtgccacattt
tcttaatccagtctatcattgatgaacaactgggttgcttccaagtctttgctattgtga
atagtgccacaataaacatacgtgtgcatgtgtctttatagtagcatgatttataatcct
ttgggtatatacccagtaatgggatggctgggtcaaatggtatttctagttctagatcct
tgaggaatcgccacactgtcttccacaatggttgaactaatttacactcccaccaacagt
gtaaaagctttcctattctccacatcctctgcagcatctgttgtttcctgacttttaa
taatcgccattctaactggcgtgagatatctcattgtaattttgaattgcatttctctga
tgagcagtgatgatgagcattttttcatgtgtctattggttgcataaatgtcttctttg
agaagtgtctgttcatatacttttccctgtttgtttttt >IGR2186a
tccacatcctctgcagcatctgttgtttcctgacttttaataatcgccattctaactgg
cgtgagatatctcattgtaattttgaattgcatttctctgatgagcagtgatgatgagca
ttttttcatgtgtctattggttgcataaatgtcttcttttgagaagtgtctgttcatata
cttttccctgtttgttttttcttgtaaaattgtttaagttctttgtagattctagata
ttagccctttttcagatgggtagattgcaaaaattttctcctgttctgtaggttgcctgt
tcactctgatggtagtttcttttgctgtgcagaagctctttagtttaattagatcccatt
tgtcattttggcttttgttgccattgcttttggtgttttattcatgaagtccttgccca
tgcctgtgtcctgaatggtattgtctaggttttcttctaggtttttatggtgttttttg
tttgtttgttttttgtttttgagacagtctcactctgtcgcccaggctagagtgcagtgg
tgcaatctcggctcactgcaacctccgacttctgggttcacaccattctcctgcctcagc
ctcccgagtagctgggactacaggcacccaccactacgcctggctaatttttttatattt
tagtagagatggggtttcaccatcttagccaggatggtct >IGR2187a
tgagacagtctcactctgtcgcccaggctagagtgcagtggtgcaatctcggctcactgc
aacctccgacttctgggttcacaccattctcctgcctcagcctcccgagtagctgggact
acaggcacccaccactacgcctggctaatttttttatattttagtagagatggggtttca
ccatcttagccaggatggtctcgatctcctgacctcatgatccgccctcctcagcctccc
aacgtgctgggattacaggcgtgagccactgcgcctggcaggttttcatcgttttagatc
ttaacgtctaagtcttaatccatcttgaattaattttttgtataaggtgtaaggaaggga
tccaatttcagctttctacatatggctagccagtttttcccagcaccatttattaaatagg
gattcctttcccccatttcttgttatttcttgtttttgtcaggtctgtcaaagatcaaatg
gttgtagatgtgtggtgttatttctgaggcctctgttctgttgcattggtctatatatct
gttttcgtaccagtgccatgctgttttggttactgtagccttgtaatatagcttgaattc
agacagcgtgatgcctccagctttgttcttttgcttaggattgtcttggctatgcgggc
tcttttttggttccatatgaactttaaagtagtttttttcc >IGR2188a
atttctgaggcctctgttctgttgcattggtctatatatctgttttcgtaccagtgccat
gctgttttggttactgtagccttgtaatatagcttgaattcagacagcgtgatgcctcca
gctttgttcttttgcttaggattgtcttggctatgcgggctctttttggttccatatg
aactttaaagtagtttttttccaattctgtgaagaaagtcattggtagcttgatggggatg
gcattgaatctgtacattaccttgggcagtatggccattttcacgatattgagtcttcct
atccatgaacatggaatgttcttccatttgtttgtgtcctcttttatttcactgagcagt
ggtttgtagttctccttgaagaggtccttcacatcccttgtaagtcggattcctaggtat
tttgctctcttttgtagcaattgtgaatgggagttcactcatgatttggctgtttatctgt
tattggggtataggaatgcttgtgaattttgcacattgattttctaacctgagactttgc
tgaagtgtttatcaacttaaggagattttgggctgagatgatggggttttctaaatata
caatcatgtcatctgcagacagggacaatttgacttcctcttttcctaattgaatacct
ttatttctttcccttgcctgattgctctgcccagaacttc >IGR2189a
ttgtgaattttgcacattgattttctaacctgagactttgctgaagttgtttatcaactt
aaggagattttgggctgagatgatggggttttctaaatatacaatcatgtcatctgcaga
cagggacaatttgacttcctcttttcctaattgaatacctttatttctttcccttgcct
gattgctctgcccagaacttccaacaccatgttgaataggagtggtgagagagggcatcc
ttgtcttgtgctggttttcaaagggaatgcttccagttttttgcccattcattatgatatt
ggctgtgggtttgtcataaatagctcttattattttgagatacattccatcaataccctag
tttattgagagtttttagcatgaagggctgttgaattttgtcaaaggcctttttctgcatc
tattgagataatcatgtgttttttgtcattggttctgttttatatgatgcattacgtttat
cgatttgtgtatgttgaaccagccttgcatcccagggatgaagccaacttgatcatggtg TABLE 5-continued gataagcttttgatgtgctgctggattcagtttgccagtatttattgaggattttgc
atcgatgttcatcagggatattgatataaaattctctttttttgttgtgtctctgccagg
ctttggtatcaggatgatgctggcctcataaaatgagtta >IGR2190a
cagccttgcatcccagggatgaagccaacttgatcatggtggataagcttttgatgtgc
tgctggattcagtttgccagtatttattgaggattttgcatcgatgttcatcagggat
attgatataaaattctctttttttgttgtgtctctgccaggctttggtatcaggatgatg
ctggcctcataaaatgagttagggaggattccctcttttctattgattggcatagtttc
agaagaaatggtagcagctcctctttgtacctctggtagaatttggctgtgaatctgtct
ggtcctggccttttttggttgataggctattaattattgcctcaatttcagagcctgtt
attagtgtattcagagattcaacttttcctggtttagtctagggaaggtgtacgtgtcc
aggaatttatccatttcttctaaattttctagtttatttccgtagaggtgtttaaagtat
tctctgatggtagtttgtatttctgtgggattggtggtgatatccccttatcattttt
attgtgtctatttgattattctctctttttttctttattagtcttgctggcagtctatca
attttgttgatcatttcaaaaaactagctcctggattcattgattttttttgaagggttt >IGR2191a
tttctgtgggattggtggtgatatccccttatcattttttattgtgtctatttgattat
tctctctttttttctttattagtcttgctggcagtctatcaattttgttgatcatttcaa
aaaactagctcctggattcattgattttttttgaagggttttttatgtctctatctcctt
cagttctgctctgatcttagttatttcttgccttctgctagcttttgaatttgtttgctc
ttgcttctctagttcttttaattgtgatgttagggtgttgatttagatgtttcctgctt
tctcttgtgggcatttagtgcataaatttccctctacacactgttttaaatgtgtcccag
ggatgctggtgcgttgtatctttgttctcattgttttcaaagaacatctttatttctccc
ttcatttcgttattcatccagtagtcatttaggagcaggttgttcagtttccatgtagtt
gttcagttttgagtgagttccttaatcctgagttctaatttgattgcactgtggtctgag
agacagtttgttgtgatttctgtacttttacatttgctgaggagtgctttgcttccaatt
acgtgttcaattttagaataagtgtgatgtggtgctgagcagaatgtatattctgttgat
tggggtggagagttctgtagatgtctattaggtccactt >IGR2192a
ccttaatcctgagttctaatttgattgcactgtggtctgagagacagtttgttgtgattt
ctgtacttttacatttgctgaggagtgctttgcttccaattacgtgttcaattttagaat
aagtgtgatgtggtgctgagcagaatgtatattctgttgatttggggtggagagttctgt
agatgtctattaggtccacttggtgcagagctgagttctagtcctggatatccttgttga
ttttctgtctcattgatctgtctaatattgacagtggggtattaaagtcttccattatta
ttgtgtgggagtctaagtctctttgtaggtctctcaaggacttgttttatgaatctgggtg
ctccatatattggctgcatatatatttaggatagtagctcttcttgttgaattgatccct
ttaccattatgtaatggccttcttgtttcttttgatctttgttggtttaaagtctgttt
ttatcagaaactaggattgcaacccctgcttttgttttccatttgctggtagatcttcc
tccatcccttcattttgagacaatatatatgtctttgctcatgagataggtcttctgaat
acagcacactgatgggtcttgactcttatccaatttgccagtctgtgttttgtaattgg
ggcatttagtccatttacatttaaggttaatattgttatg >IGR2193a
caaccccctgcttttgttttccatttgcttggtagatcttcctccatcccttcattttgag
acaatatatgtctttgctcatgagataggtcttctgaatacagcacactgatgggtct
tgactcttatccaatttgccagtctgtgttttgtaattggggcatttagtccatttaca
tttaaggttaatattgttatgtgtgaatttgatcctgtcattatgatgttagctggttgt
tttgctcgttagttgatgcagtttcttcctagcattgatgtcttacaatttggcgtgt
ttttgcagtggttggtacaagttgttcctttccacgtttagtgcttccttcaggagctct
ttaaggcaggcctggtggtgacaaaatctctcagcatttgcttgtctggaaaggatttta
tttctccttcacttatgaagcttagtttggctggatatgaaattctgggttgaaaattct
tttctttaagaatattgaatattgaatagtggcccccactctcttctggcttataggg
tctgcagagagatccactgttagtctgatgggcttccctttgtgggtaacccaaccttt
tctctggctgccctaacatttttccttcattcaaccttggtgaatctgacaattatg
tgtcttgggggttgctcttcttgaagagtatctttatggtg >IGR2194a
tattgaatagtggcccccactctcttctggcttatagggtttctgcagagagatccactg
ttagtctgatgggcttccctttgtgggtaacccaacctttctctggctgcccttaaca
tttttccttcattcaaccttggtgaatctgacaattatgtgtcttgggggttgctcttc
ttgaagagtatctttatggtgttctctgtatttcctgaacttgaatgttggcctgccttg
ctaggttggggaagttctcctggttaatatcttgaagagtgttttccaacttggttccat
tctccctgtcactttcaggtacaccaatcaaacctaggtctggtcttttcacatagtcc
atatttcttggaggctttgttcgttccttttcattcttttttctctaatcttgtcttcac
gctttatttctgatatccttctcccgctagattgattcagctatggatacttgtgtatg
cttcacaaagttcttgtgtgtgttttttcagctctatcaggtcgtttatgttcttctctaa
actggttattctagttagtaattcctctaaccttttttcaaggttcttagcttccttgca
ctgggttagaacatgctcctttagctcaggggtttgttattacccaccttctgaaggct
gtcattcgtcaaactcattctccgtctagttttgttccc >IGR2195a
gtgttttcagctctatcaggtcgtttatgttcttctctaaactggttattctagttagt
aattcctctaaccttttttcaaggttcttagcttccttgcactgggttagaacatgctcc
tttagctcaggggtttgttattacccaccttctgaaggctgtcattcgtcaaactcat
tctccgtctagttttgttccttgttggcgaggagttgtggtcctttggaggagaagagg
cgttctggttttttggaattttcagccttttttgcactggttttcctcatcttagtgcatt TABLE 5-continued tatctatctttggtctttgatgttggtgaccttcggatgggttttttgtgtggacgtccg
ttttcttgatgttgatgttgatgctgttcctgtttgctagttttccttctaatagtcaga
cccctctgctgcaggactgctagagtttgctggagatccactccagaccctgtttgcctg
ggtatcaccagcagaggctgcagaacagcaaaaatttctgcctgttcctacctctggaag
cttcgtcccagaggggcaccccccagatgccagccagagctctcctgtatgaggtgtctg
tcgaccctgttggaggtgtctcccagttcggaggctcgggggtcagggacccacttga
ggaggcagtctgtcccttagcagagctcaagtgctgtgct >IGR2196a
gcagaacagcaaaaatttctgcctgttcctacctctggaagcttcgtcccagaggggcac
ccccccagatgccagccagagctctcctgtatgaggtgtctgtcgaccctgttgggaggt
gtctcccagttcggaggctcgggggtcagggacccacttgaggaggcagtctgtcccta
gcagagctcaagtgctgtgctgggagatccgctgctctcttcagcgccggcaggcacaac
atttaagtctgctgaagctgcacccactgctgccccttcccccaggtgctctgtcccaag
gagatgggaattttatctataagcccctgactagggctgctgcctttctttcagagatgc
cctgcgcagagaggaggaatctagagaggcagtctggctacagcggctttgccagactgc
agtccctgggggctttgtttacactgtgaggggaaaactgcctactcaagcctcagtaat
ggtgacgccctcccaccaccaagctcaagagtcccaggttgacttcagacagctgtgc
tggcagcaagaatttcaggccagtggatcttagcttgctgggctccatgggggtgggatc
cgctgagcaagaccacctggctccctggcttcagccccctttccgggggagtgaatggtt
ctgtctcactggtgttccaggcatcactggggtatgaaaa >IGR2197a
accaagctcaagagtcccaggttgacttcagacagctgtgctggcagcaagaatttcagg
ccagtggatcttagcttgctgggctccatgggggtgggatccgctgagcaagaccacctg
gctccctggcttcagccccctttccgggggagtgaatggttctgtctcactggtgttcca
ggcatcactggggtatgaaaaaaaactcctgcagctagcttggtgtctacccgaatggcc
gccctgttttgtgcttgaaacccagggtctggagatgtaggcacccaagggaatctcctg
gtctgcgggttgcaagactgtggcaaaagcatagtatctggggccagagtgcactgtttc
tcatggcacagtccctcatggcttccttggctaggggagggagttccctgtccccttgc
acttcctgggtgaggcgatgccccaccctgctttggcttgccctccgtgggctgcaccca
ctgtctaactagtcccaacgagatgagccgggtacctcagttggatatgcagaaatcacc
caccttctgcgttgatctcgctaggagctccagaccagagctgttcctgggctttaacg
ttttagtgctcatttgtttggcatggggtgggggcaattctatgaggacatttagaat
tttcagaactattttgctcataatcaggggttgcatgagc >IGR2198a
gagatgagccgggtacctcagttggatatgcagaaatcacccaccttctgcgttgatctc
gctaggagctccagaccagagctgttcctgggctttaacgttttagtgctcatttgtt
tggcatggggtgggggcaattctatgaggacatttagaattttcagaactattttgctc
ataatcaggggttgcatgagcattaagttttcaaatctcttcagtagacgaaccatgcaaa
ataccaatatcactgtgtattagtatttagcagtcttatccttgatgtggagtgtatcct
cacacttcctctatgagaagtcttttgtgagacttattcccaggtaaagagccagtcagg
ggcctggctgctgcccctctggctggcgcaacagacagatgatgtcccagtgtctctggcg
gcttcttacagaactctgtccctgaggttatgtcccttcttcatgaggtgacaccttcag
gggtgggtctgcctgagagctccaaaacatgattctgctgagaaacctgtgtctgtcat
cagtgcatcctctgttaatctcatgagattttattttccaaagtgcttttaaagcaatgg
catagaacataaggtgttgccagtgcattgcatcaagcctctatcagcctaaaagccctt
taggaaaagaattaaaagacaaaccccagaagaaagttc >IGR2199a
ctccaaaacatgatttctgctgagaaacctgtgtctgtcatcagtgcatcctctgttaat
ctcatgagattttattttccaaagtgcttttaaagcaatggcatagaacataaggtgttg
ccagtgcattgcatcaagcctctatcagcctaaaagcccttaggaaaagaattaaaaga
caaaccccagaagaaagttctattgtgctatttactacctggcagggaatagggtcttg
tgcccacctcattgaccgtcacttagaccaggtattaagcagaataattctctttgacaa
acaacagccttatggaatccatgagaatgttcagggaaccctgacagagataagaattag
tttccaagaataggaaaagatggtatggcaaatctttgcctttactttgatctgtggcag
gaaactggttttttaagaaaatctgggttgttcctccacctccttttctttgtcttttata
tttctgtgggtatgctggtttctagttatacacattaactgaacacctcatcactcacca
actctgcccctgtggctacagtttgtgtatgcctctctcctggagcagaggagatccttg
gtctgataacacactcagtcttcccaaagtcatggctctaagggaaacaagccacacacg
aatccaacaggcttcgacagaggacttggaattccacatg >IGR2200a
ttctagttatacacattaactgaacacctcatcactcaccaactctgcccctgtggctac
agtttgtgtatgcctctctcctggagcagaggagatccttggtctgataacacactcagt
cttcccaaagtcatggctctaagggaaacaagccacacacgaatccaacaggcttcgaca
gaggacttggaattccacatgcttggctcaacctggaagtgacttggctcttgcctca
ccacatgaagagctctaagcattcaggtaattatggttttttgccctcagaaggccacaaa
tgactggaatcagtggcatggagaataagagagaaatgcagaaactattcactcctgct
acaggacaagggtagacagaactgcaattcagattctagagccccctgggaagacagtta
atcagtagtccagcacagaaccatgtttgaggagagtggagaagccaacagtgttccaga
agacgtgctgccttccttctcccccaagtttgatgctgcttgttttgttatgcaacatgc
ccttgagtttctatccaacactggagctttttacccaggtccatccacaccttctagccc
aaaatgcccctgtgcaaattgtatatagattaagcacacctcttgtgcaccacactcaaccc
ccaatcctctcagcccaccacttactccagccactgttgc TABLE 5-continued >IGR2201a
tcccccaagtttgatgctgcttgttttgttatgcaacatgcccttgagtttctatccaac
actgagctttttacccaggtccatccacacccttctagcccaaaatgccctgtgcaaatt
gtatatagattaagacacctcttgtgcaccacactcaaccccccaatcctctcagcccacc
acttactccagccactgttgcagtgaccagttctgatgggctctggcaacccctacttca
gccctgcaatgtattctctcttgctttctacccacgggacagaacttatttgggactcat
gcatgtgcagcctggaaacatgtggagctgacacctgtgggctgcctttacaaatggatg
ccaacagagaaatgcttccccctttactcaaggtacagatggtgttgagatgcatttca
taagcttcttctgaagtccttgctggatggagcatccctgcctttggtgctagtcaacct
gaaaatgcatctttgtattcagcctccctccttcctgttctcctcctgtcctttattgc
tgctccctggaatcttgtccccaaagcataaactgcttaactgcacagaagcacttgtct
cagtctctactttcaagggaacccaagatacatttgtgcaagaaggctggctcagcccat
agtcaattaataaagtgaagaattctagtgcacaagaatc >IGR2202a
cagcctccctccttccctgttctcctcctgtcctttattgctgctccctggaatcttgtc
cccaaagcataaactgcttaactgcacagaagcacttgtctcagtctctactttcaaggg
aacccaagatacatttgtgcaagaaggctggctcagcccatagtcaattaataaagtgaa
gaattctagtgcacaagaatcaaatcttagtcttagagattaatcccaaccattgctaga
attagcccaagctgatacagagaaaaggcagatgacagtgtggcacaggctcactaaatt
ctagaaataaagattctaggcagttgctgatatttaaaaaatcatttttacttattaaac
tttctcatttcccaaggcacttcagtagctttcacaaaaacatgtttgttcttttttaac
caggtgaggcatatgctttaggagtaccatggtaacataatcagcaaagagaagacaatt
acactgaacacaaaatatcacccaataaagttacaggactaaagtgagctactctgaaag
actatgaacacaatttaaatttcttttttgtaatatcctcccatgactaagtatcaagaa
aggaacacacacaatgacactgttttggcacttagagaagtgctagaggctagggctgg
taaggccttgcaccagtggcagctgcagacaattgccaga >IGR2203a
acccaataaagttacaggactaaagtgagctactctgaaagactatgaacacaatttaaa
tttcttttttgtaatatcctcccatgactaagtatcaagaaaggaacacacacaatgaca
ctgttttggcacttagagaagtgctagaggctagggctgtaaggccttgcaccagtgg
cagctgcagacaattgccagagtgattctgtgtttaaaaaaaaaaaaaaagacacaaa
ccaggaggctaaggaaccagcctttcccaagtgcattctgaagggcaaataacaaggaga
aaaggatacaacaacaaacaaataaacagtaaaacaaaacccacattacagctttgagag
aaaagacaacgttgctcatctctctcacctgataaatttcctttaaaccatacataagac
gctatagtagcaaggaggtttccacagcagtggaaaacaagaatagtagattcaatggag
catttattatgagcctggacaagcccagtgctttgatcagatgtaaacaagtctactcag
tcgtcatgctgagtggtcttaagagctcacacatcagtgcactttgctggtgatctgcat
ctgctcattctgctccatcttcattacctttcactttccctagctctgcgctctcctgcc
ctggggaagcaatgatccagttaatgtcctctgtaactga >IGR2204a
caagcccagtgctttgatcagatgtaaacaagtctactcagtcgtcatgctgagtggtct
taagagctcacacatcagtgcactttgctggtgatctgcatctgctcattctgctccatc
ttcattacctttcactttccctagctctgcgctctcctgccctggggaagcaatgatcca
gttaatgtcctctgtaactgagaaaaggtaagaatcaaactccttgtgcaattacttcct
tttcctctaaagttcaccactagaggggagtggggaagggtggggacttagacctct
agccttattagggccttttcaagtagtctaaaattaaaatgtacatttagcatatgctt
ctcacattcctccagatctcactggttctagtgaaaaattaactgctttggaggtgctga
gtccatcattgtaatagttaggacttagatgaagttgtctgtaggtagccccagtgtccc
tagaggaaggtggtgctctagggccatatgtagcctctgagtgtgggtgcccatccagga
gcaagtcagacaggtcaagaggacaaacagcaaaggcctttgtcactgaaggactcgg
agtctgcacaagctggccatttctggcaagacagtctttcctcttcagtttctcccttac
tggaagcgatgttagaaggctgtgcttttaaggattgtgg >IGR2205a
agggccatatgtagcctctgagtgtgggtgcccatccaggagcaagtcagacacaggtca
agaggacaaacagcaaaggcctttgtcactgaaggactcggagtctgcacaagctggcca
tttctggcaagacagtctttcctcttcagtttctcccttactggaagcgatgttagaagg
ctgtgcttttaaggattgtgggccttttcttgaccatcttttaacatccttgtgtgacttg
gagttttttctgtgtttcattctataaaaacaagcaaaaatatgtcagtaacacatttaa
aaagatgcctcccagtctccaaacaaacaagaactgaggatatcttccctgggaagagaa
tcctgcagcagattctgaaaggtttcttctagcctctgagttatccagtgcggctactgc
catggagatgtgtatagtgacatgtccacacaggaacagaccagagaggatgggctataa
gtaagcaccttgccatttacaacccctttaatggctaaactagtccatggtgtctgtgaga
gggagtttgcgagtagctctattgtgaggggctcctgagacctggccagacccagaccca
gtgcatcaacactgacagaggaggtcttcttacccttgactcttagcatctggtcaatg
gtgtctgggagtggggtaccgaagctctctgggagaaaca >IGR2206a
caacccttaatggctaaactagtccatggtgtctgtgagagggagtttgcgagtagctc
tattgtgaggggctcctgagacctggccagacccagacccagtgcatcaacactgacaga
ggaggtcttcttacccttttgactcttagcatctggtcaatggtgtctgggagtggggtac
cgaagctctctgggagaaacaaggtgaggatggctgtcaggatggtcagacttcccatga
gaatgtagggcaggaagcggtcgtaggcacctatggcaaagcagacggagcctcaggccc
agggctgcagttagacttggtctctcatctaccccttatgctcccaggactctggaagg
ggatcactttccttcttggtctcacatctctcacagtctgagcagtcagattagaatctg TABLE 5-continued gcatctagacaggtttcagaacccagagctggcacaggcatgcccagagcccagcagtgt
tccaccatgcagggaggagtacaaaggggcggttgcaggagaagagctgggccatgctg
attattcctatttctgggccatgctgattattcttatttaccaaggttgggtttccaagg
aacctgaggtacttgtccaggatggaaataactcttccacctctgcagatgtgtcccag
cccatgtgatctgccttcagattaggcagggtgcttttgc >IGR2207a
gtacaaaggggcggttgcaggagaagagctgggccatgctgattattcctatttctgggc
catgctgattattcttatttaccaaggttgggtttccaaggaacctgaggtacttgtcca
gggatggaaataactcttccacctctgcagatgtgtcccagcccatgtgatctgccttca
gattaggcagggtgcttttgcttgctttgagatctacatagcatgttcacaaagcactct
gagtactctcaggtgggtgccaccctccctaaagaggtactggctagggatgtgcaggga
aaccacaggtgctatgaagacataattctgagaagagaaaactggagacctgctacataa
aatggcatggggtggatcttcacacaagataaaatcactctatagtgctctaggttataa
taattttacgttcatcagacctcttgcatggacatctttcccctcatgttccttttaaac
tctgattccaagaaatttctccaactaagcacactggctccctaaaccactctgtaggtt
cttaggataaaggaattgtagtctctgatggaaggcctgggatggctaaaacagaaacaa
accctctaatattctcatcaatttctaggtaatctataggttgttttccatttgaaagtg
agggccagtgcactgggacaagaacccttcccggccaaag >IGR2208a
tccaactaagcacactggctccctaaaccactctgtaggttcttaggataaaggaattgt
agtctctgatggaaggcctgggatggctaaaacagaaacaaaccctctaatattctcatc
aatttctaggtaatctataggttgttttccatttgaaagtgagggccagtgcactgggac
aagaacccttcccggccaaagatccagtactggatggagcccatgtactgtatgaacttg
ttttcctgttaacacgcaacctccagctcacattcaagccagttagtacttccatcccgt
tgctctagtgtgcccttggctcatgggacttaccaaggtaaacgaagtagggagacagga
tgctgcccaggcgggatgctgtggagctgactcccacacccatgtttctcaccactgtgg
gatacagctcggctgtgtacacgtagaccatggaaaaggcagccgtgactccaaacttgc
ccaccatcaccaggactgtagccaaataatacaagtctggagaagcaaaggaaagagggt
aggagtaggtaccaacccatggcatgcagctattgagagcaaaacaaacatactttcttc
ccaaattttttggggagtcagtttctatcacttcctattgtgggggaagggctatagcc
aagatttccctccaaattgattgctgaaaggaggctggga >IGR2209a
agccaaataatacaagtctggagaagcaaaggaaagagggtaggagtaggtaccaaccca
tggcatgcagctattgagagcaaaacaaacatactttcttcccaaattttttggggagtc
agtttctatcacttcctattgtgggggaagggctatagccaagatttccctccaaattg
attgctgaaaggaggctgggacctgcagctataaggacatgcactttcctcaacctggag
accaccagagtaagctccttaatagtccaatcaacctgcttcccagtctataagtcatta
aagacatgtctgtcagggattaactgtcaccccagaacctcacactgcaggcactatgga
attaactcatgatgtttagatgaatggagaattcagttctaactcatttcatgctttcct
cccactcagacctcaaaaaaatcataggccatcagaatctcgagttgatcttctaatctc
tctgtgctgtgctgatgggagagctatgtgtgacctgaaggtcactctgagctcagctgt
gagcctctacatcagttctgggctcctcctgccacatcccatggggagctgttcccgtgc
agtgttctcagcctgatgggcccaaaagtgaccatcagaggctcccaaatctacaggtac
actgaagtctctgggcacagtgatggagagggagagatga >IGR2210a
agagctatgtgtgacctgaaggtcactctgagctcagctgtgagcctctacatcagttct
gggctcctcctgccacatcccatggggagctgttcccgtgcagtgttctcagcctgatgg
gcccaaaagtgaccatcagaggctcccaaatctacaggtacactgaagtctctgggcaca
gtgatggagagggagagatgagggcccatgaactgttctataaattattggaaatggcta
cctcccacccatctgtgggatactaagatagtttcagaaataaaatcctgctaaggtct
gtgaggccctctcagtggtctggcccctccccttctccctcctcctcaaacatgccaggc
tcatcccctgctcagggtcgctgccttttgccatttcttcttcctaaaatgttctcctaga
cttttttcagggctttctgtcactttatgtacatttctactgaactgcccctgttcaggg
acactatctgtgactatgtaaactaactcggcattgtccttcatttgtattcctagaagg
taacacagtctgaactatattaagcattttatttacttgtttgttgtctgtcttctcatc
tagggtgtacgttccatgagggcctgggttctgcctggcttgttttcttgtgtatcgtt
atcaccgagcacagtgcccagcccatggtaggcatgccat >IGR2211a
aaactaactcggcattgtccttcatttgtattcctagaaggtaacacagtctgaactata
ttaagcattttatttacttgtttgttgtctgtcttctcatctagggtgtacgttccatga
gggcctgggttctgcctggcttgttttcttgtgtatcgttatcaccgagcacagtgccc
agcccatggtaggcatgccatagcctatttgttgaataaataaagaagacagggccaggaa
aaaaaggaatgggatagctatttcttccctcttcttctgcagtggaaaacagtatgagca
cattaacttgggtacagagtaaaattaaccaacagcccaatggctgcttttcccactc
cctcaaagcccaggccataagtgttctagtctcagaagacactttctattgattttttagg
ccaagaatgtatataagcaagggagctgtgtgggcttgattttattctcttttattaatt
gagacagcctggtagacagtaagagactcagtgaagaccccaaaccatagatgcacatgg
tccctacctgggggtaccagctgcatgaagagaaggacactgccacccaggaagagggca
gtggccatggaatagcgccggggcaaatattgcagcagcagccaggccaacacatatgct
gggacttcaaccatcgctgaaaggaagcagttcacaaaga >IGR2212a
taagagactcagtgaagaccccaaaccatagatgcacatggtccctacctgggggtacca
gctgcatgaagagaaggacactgccacccaggaagagggcagtggccatggaatagcgcc TABLE 5-continued ggggcaaatattgcagcagcagccaggccaacacatatgctgggacttcaaccatcgctg
aaaggaagcagttcacaaagatgtccccatgcaagttaggagtatcaagcgaaagcccaa
aatagcccactgatatggtcatcctgaaacagagtgcagaagaaagctggaaaagcagta
tccacatctttcccaacctgtacaacttttacaatgcaattatttcagtaaattccaaac
catctttaagcagagactagtaaggcagcagtaactgtaaccctgcgtcttacttcatag
atcaaaagataattttcccagcccaagtggtacagtgtaaaccctgcgccagtgcgctc
tcagagccttccatatagacagtgtcccagcaaaaaagcttgtataattcagatagattt
acttcattgaaaagaaaaattccaacctgcctttcagctttaaaaatcctaagctgaacc
tcctcaaatccagcaactgcagaaggagctagagaatgagtcaggaggcagacatcaagt
gaggtgtgataggatttgggggataagataacaaaaggaa >IGR2213a
cagtgtcccagcaaaaaagcttgtataattcagatagatttacttcattgaaaagaaaaa
ttccaacctgcctttcagctttaaaaatcctaagctgaacctcctcaaatccagcaactg
cagaaggagctagagaatgagtcaggaggcagacatcaagtgaggtgtgataggatttgg
gggataagataacaaaaggaacaacattaggtcaaacacttggagagagaccctcacaca
ctacctgtggtgaccagtcaggaagaggctggtcagagacagctgacaccagcccgcgg
tacttgtggagcagagaggtggctcccaatggagggccacactgcctctcatcaggatg
ccctgcagtacccctgacctgggcatcccagtaggcattctctctgttgatgacccaca
ctctttgacaaaccagaccttttatggattagactgttttgactcatctgcaggtggaaca
cacagctggtacaataaaaaagagtatgtgcatgagtccccaggaaatccagagcagggag
gagagcctgggtgaacacaaaagtgggtgactcatcacaggcttgcatgtctgtggtgca
ggctacatgctgctcctgtcttgaggccaactcagggaatggtgaactgcctggagggat
cctgggccattccttggaagcgggtgactcatagcactcc >IGR2214a
agagtatgtgcatgagtccccaggaaatccagagcagggaggagagcctgggtgaacaca
aaagtgggtgactcatcacaggcttgcatgtctgtggtgcaggctacatgctgctcctgt
cttgaggccaactcagggaatggtgaactgcctggagggatcctgggccattccttggaa
gcgggtgactcatagcactccctcagtaggcacagtggctgactgcctcaaagctggatg
agactagtaataaggactctgagatgaagtccgccctcctcgcccatcttctcaccgcta
acccaccaggctccagaagtcgcctagaatcccagggttcggccgctgagcaaaagctag
cgatgtgcacttggacatgtttcctctccctggtaattcacaaatccctttctgacatac
tttgcctcattagtgggaacctggtaaggacatctaggctatagccctgactccaggacc
gtttatggacatcccaggaggagcacatcccacttccacatttccagaaagtaactggca
gcctctgcagcctacaggacatggtgtcttcactcagatccttcttaaaagccctacctg
gcctcctcagccactgtcggtaactgggtaggagacgggaactaaatgacccaaattggg
caaggattcatcttaagatctggagagattccccacgaga >IGR2215a
ggagcacatcccacttccacatttccagaaagtaactggcagcctctgcagcctacagga
catggtgtcttcactcagatccttcttaaaagccctacctggcctcctcagccactgtcg
gtaactgggtaggagacgggaactaaatgacccaaattgggcaaggattcatcttaagat
ctggagagattccccacgagagtccatatttcccacaacagcctccacaattgttttcat
tctccttttctgaggttccatcccattaagaattgtgacatgccatttttttccatctaa
cacaagacatatccttttcactctctgatgcataggcttttgaattttgtctgaggcatg
tctgtaaacaagaggcccaatggccacttcaagaagctttgtctggaagcctcaggcagg
tctcttttacataccacagcattatggacatgatggtgaccatccggatattccaggttc
gaagcagatccagaatgttgtgggactgctgcttcttggaacttaggtcttgtaactgca
ggaacaacatcataagtgtatgggaagaagaggtggtcagagactcagagcacacaataa
catacttgaatccctggcatcttagctgtctgcatctcagcgtcgggagtgttacgttt
ctaagaacagtaagtatactgactgtgttttaggctgtga >IGR2216a
gtgggactgctgcttcttggaacttaggtcttgtaactgcaggaacaacatcataagtgt
atgggaagaagaggtggtcagagactcagagcacacaataacatacttgaatccctggca
tcttagctgtctgcatctcagcgtcgggagtgttacgtttctaagaacagtaagtatac
tgactgtgttttaggctgtgaaaacttccctaggccttgtcagtaacaaatcagagtgaa
tgaaaatgaggaaaagtaagtgaccagtccctcaagggtacaggaagacagaggcccagg
ctgacagcttcctcactgcaccccacatattcctgtcggtggccacattccaaggaggc
ctctaagtattcctcccgaagcctggctccctgccctctgggtcagagagagtacctggc
tgtgtggtttattggtctgatatttttttaaaagttaatgttttgagtccttatactatgt
agttactggtgtgcttccaggggaaaaagaattcaaatagaaaaacaggaaaattgacctg
agcttcacccagagtgacttcctatgaaattcagcacagccaaggccattaataaaccac
acgtctaaacacactgatgttgctttcttaagcaaacccaggtttggagcttgttttttcc
agagttagaagttcaacaaaaggtcaactttggactgaaa >IGR2217a
gggaaaaagaattcaaatagaaaaacaggaaaattgacctgagcttcacccagagtgact
tcctatgaaattcagcacagccaaggccattaataaaccacacgtctaaacacactgatg
ttgctttcttaagcaaacccaggtttggagcttgttttttccagagttagaagttcaacaa
aaggtcaactttggactgaaagtatccctgaaatagcctcatttcctcaaagatgccag
tggggcttatgcattcacccagattgaccctcacttaaaagcccccaaaaccacctaac
ttaaaagccctctgccacactcctgcctgacctttgcgcacaggaccccttttctggtgca
tgctgacagtggctgctgggccaccactcactgggaagtctgcagggctggcagtggcca
ttggcctccgctgtctacaataactgttccctcttttccaagcccaaccatgcctgcctc
tcacacttcagcagggctgcttgtggctgttcccacacccaaccctcatcttccagtca TABLE 5-continued gaccacagacacattccagaacccaccaggcagcatttacagcttctaacctctcatag
tcacgagaccaaggaaaactgcctgctacagagatggtaggagagggaacgggaaggaaa
agcaagaaccaggaactaggtagagccaagaaatgagtca >IGR2218a
cttgtggctgttcccacacccaaccctcatcttccagtcagaccacagacacattccag
aaccccaccaggcagcatttacagcttctaacctctcatagtcacgagaccaaggaaaac
tgcctgctacagagatggtaggagagggaacgggaaggaaaagcaagaaccaggaactag
gtagagccaagaaatgagtcatggtgtgtgagaacagggctgacgggagggtggggtag
ggggaagaggtggacatcaaaaaggacctgactccaagatgatatgcaataattaaccat
tggagggcagaaagagactaaacacttttttttttcttttaatgaataattgctaatact
caagagatgaaatacttctaactccaaatctatttgtgctttacattttacgtttgggt
tagctttgtaaggtgacaagccacctaggtataagaaacaatgattttcccaaatgctg
actttatgaaaggcctattactcaaaaagagtatttattgttagaagtaatggttaaaat
atatgattgcctagaaaggaagtaaaaaatgaaaatctgaaacccgtggtgaaagagtg
aggcagctgtaacctattcctcaacttctgagtgttaacagggcccgtgtggggggtgggg
agtgggggatgggggaatgggcagttgggcttgggca >IGR2219a
actcaaaaagagtatttattgttagaagtaatggttaaaatatatgattgcctagaaagg
aagtaaaaaatgaaaatctgaaacccgtggtgaaagagtgaggcagctgtaacctattc
ctcaacttctgagtgttaacagggcccgtgtggggtggggagtgggggatgggggaa
tgggcagttgggcttgggcagagagagggctggctgctgtgagcaggaggacttcag
ggctgggtgctgctgctctcaaatcacggtcagtctgtccctctcacccacacccacatg
gtgcttacctcactcgggtcaaagatagtggaaggcacaacaatcccattggctttggca
gccttgcggatgatcacctctgcctcttcaaatcgtccctgagagatgagccatcggggg
gactcagggatgaacctggcagtacaaggtccaatctcagtgaggcctcctgccaacag
cagacccacagaccaggtagagcacagccataggtgggaataaggttgcagaaccagagc
ttgtggaatgtttggtgatcacaagccagaagcaaagagctgatccacacgcagcaataa
cctggggtggatgagcttatgtgtacccacaccgcacaaaaatgggagagccctgcacc
ccctgacggcatccccatgctggctggccacctccatttc >IGR2220a
gagcacagccataggtgggaataaggttgcagaaccagagcttgtggaatgtttggtgat
cacaagccagaagcaaagagctgatccacacgcagcaataacctggggtggatgagctta
tgtgtacccacaccgcacaaaaatgggagagccctgcacccctgacggcatccccatg
ctggctggccacctccatttctgaagagcagtgttgccatctgctgggctgaggagatgg
gtgcaagatgggctccggaagcctggcttctgtgcatgtctatgtcagcccaggccctgc
tacactctcctccctgtccccggcaccaacagaagcttctgcactggccttttagcttct
cttctctcctcaccctacccctgatttatccaacagattagtcagatactctacctaaaa
tagcatgtttggccaggtgcagtggttcactcctataatccagcactttaggaggccaa
ggccggtggatcatttgaggctaggagttccagaccagcctggccaacgcagtgaaaccc
gtctctccaaagaaatacaaaaaaaattagccaagtgcggtggcaggcacctgtagtccc
agctactcgggaggctgagacatgagaatcgcttgaactggggaggcggaggttgcagta
agtggaaatcacgccactgcactacagcctgggcaacaga >IGR2221a
gctaggagttccagaccagcctggccaacgcagtgaaacccgtctctccaaagaaataca
aaaaaaattagccaagtgcggtggcaggcacctgtagtcccagctactcgggaggctgag
acatgagaatcgcttgaactggggaggcggaggttgcagtaagtggaaatcacgccactg
cactacagcctgggcaacagagactttgtctgagaaaaaaaaagaaaaaaaagaaaaa
gaaaagaaaaaagaaaaaaattagcatgtttatcaaggcacttgagtgctctatggat
attatttccaccttgctgggaccaggtagccgcccccaccctcggtcatgactgggcc
ccatgatgtgcggcttactctcccactatgccctgaaatgctctgtgctccacttgggct
ggtgatctcaccttctccacctgcaagggtgattcccaccttagcacctctgcagtgtt
ccctcttggtctggaatgcctcttctctgcctgttcaactcctctaccttggtggtgc
agaaggagcctggcttcctccatgtggctaccctgaggactcttgcttttggtgccagtg
cctgtggcatgaggcttcagcagcacacagccagaactagggcctacactgtcctgccct
gaggcttgggaacttcctacagggcatgctggaccccatc >IGR2222a
gcctcttctctgcctgttcaactcctctaccttggtggtgcagaaggagcctggcttcct
ccatgtggctaccctgaggactcttgcttttggtgccagtgcctgtggcatgaggcttca
gcagcacacagccagaactagggcctacactgtcctgccctgaggcttgggaacttccta
cagggcatgctggaccccatcttctcacagctactgctattttccccacacttggggca
acccagcacagggctgagagcaagtctgttgctgtcatgggattctgttttgttttggct
cttttgagtgtggagaaaacattctgaaataatttataatctatgcttcctgtctctggg
agacaaaataggggattcatgggttgttgctgccctctagtgaaggccagacagaaatcat
cctgccagtgggcacatggggcacagggtcacactcaccaccagagtgccacgcacagca
ccccggcatcgtcagcgccaccagcagcatccgccagtctcggatgaagtaagcaaaca
gtggcagcaccatgtagccaaatgcataaaatatgcacactcctaacgtagagaatatta
tacgaactgacttgccaagaatttctgtccctgttcaaaacaagggaggtcgagttagca
gtttaatttgggttccttccttattaatttttatggtat >IGR2223a
caccagcagcatccgccagtctcggatgaagtaagcaaacagtggcagcaccatgtagcc
aaatgcataaaatatgcacactcctaacgtagagaatattatacgaactgacttgccaag
aatttctgtccctgttcaaaacaagggaggtcgagttagcagtttaatttgggttccttc
cttattaatttttatggtatctttgtgaatacacagacaagaaaacagcgagaactctc TABLE 5-continued tctaagttcatggcgctagggagcggatggcgttctgaaccctcctgtctgactgtctc
ctggggtacatccctgtggcctctcaggcccccaagcaacagttctctcttgaaattt
cgccatgttctgaagccatgtgctaaagatgccatggtaggccccctttaatcctcact
gaggaagaatttattaaaagtgaagtcattactaagtcagcacatgctgacttaagcctc
aaggaaagaatattaaatataaaagaaaaaacaacccttttcaacaatacaacccaagga
actcaaaggccttatcagctagagtcaggttcctccaaacacaggccggcctggcagctt
ctcagtgacaacaggctggcacatttgagacaaagccctgcagtgtgcactctgaattaa
aaccctgaaggtgacgaaagccccttcctatcaatttatt >IGR2224a
taaaagaaaaaacaacccttcaacaatacaacccaaggaactcaaaggccttatcagc
tagagtcaggttcctccaaacacaggccggcctggcagcttctcagtgacaacaggctgg
cacatttgagacaaagccctgcagtgtgcactctgaattaaaaccctgaaggtgacgaaa
gccccttcctatcaatttattcttgtccgtagatatcaccagccacagtgctctgcagac
aagggggttctctaccttagcaagcttgccagtcacagcccctcctcctccaaccatgccg
ccctcttttctgggctggctcagccctgtgcagtggcaggcccttttgtaaatggagga
tctctggtgagtcctagtaaattgactaccaagtactaagaccaaggagccacagcccag
aggccagaaaagaactggaaatcagaagtcaggccattgtgctgctgggacccaggct
ggtctcatgtctggctcagtttccctgcctgtaagtaaggttcaccaggaagctctggct
agttttgttagaaaccctgtccccttgagggacatcacagctgtctccagaaaggtagg
tgatgggatgatggtgaaatacaggatcaagtactcaactccaacctgatggccataccc
aggacaaatgctgccacatagttggagatctggcccatgc >IGR2225a
tttccctgcctgtaagtaaggttcaccaggaagctctggctagttttgttagaaaccctg
tccccttgagggacatcacagctgtctccagaaaggtaggtgatgggatgatggtgaaa
tacaggatcaagtactcaactccaacctgatggccatacccaggacaaatgctgccacat
agttggagatctggcccatgcctacaaggacaaacagcacgacaaacatctcaaaattct
tcgagaagatctgcaggaagctgaagcctgtctgcatgcccatggtcacgaacagcacat
tcttccggccaaacctgggaagaaaaggagagtgacagataaccagctggaaaagggcag
caggaatgggctccaccaagtggggctttctcaagatccatccagtaagtgggtgtgaac
agtgttgccagaatactggctgccagggacagtctcggtctcacagtgcccatgctattt
ctcccccctcccactccccatgacaaatgtacagcctgggtaccagggttgcctaaaaag
caatgctacaattatgataatgattgcaagagactgaaatacatcaattatttaatccat
acattcataatgatattttttttaaaaaagaatctgccaaatttggagaataacagagaa
acaattcattataaatgaaaactggcaaataaagagaaag >IGR2226a
atgacaaatgtacagcctgggtaccagggttgcctaaaaagcaatgctacaattatgata
atgattgcaagagactgaaatacatcaattatttaatccatacattcataatgatattttt
ttttaaaaaagaatctgccaaatttggagaataacagagaaacaattcattataaatgaa
aactggcaaataaagagaaagaagcatttgtcctgattttcctttgtaaactatgtgaac
agcaaccaataatagataagaggtagtatcatgtacaaaagtattctaacttttaaatga
aaaggtaataaaattagaataataccatttatagcccccaatggattaatagatctatgc
attatatactaattactgttaacatcataaagagacagtcaggaattgcatgcttcctat
ggtcttgccaaaaggactgaacctgaatcagaacctgaatctcaagtctctggatccaac
tgccaattttgaggaaatgcagagcatagaggaatgtgctgaactgcatcatcagtgtgc
aatcaacaaatccagactgggaaattctataggtggaatagctcaggttcttcatagata
atcagtaaggcatagaaggcgatagaaggagaatccatagattaagtagactaaaagaca
tcaaatatattaagtgggcaacactaaatttgtgtcaagg >IGR2227a
cagagcatagaggaatgtgctgaactgcatcatcagtgtgcaatcaacaaatccagactg
ggaaattctataggtggaatagctcaggttcttcatagataatcagtaaggcatagaagg
cgatagaaggagaatccatagattaagtagactaaaagacatcaaatatattaagtgggc
aacactaaatttgtgtcaaggatgcatatttcgataataaaactaaaaaaactcacaagg
aagtgattattacaggagtcaggctagcggttacttaatggggagagagaggatgctg
taattgggatggggcacatggacagggcttcttagtggacagcaaagttctactgctcga
cttggtggtggtcataaggttatttctctgaaaaaaattcattaagctacacatttgttc
tgtgtggttttctgtatccgtgctcattttaaaaagttttttaaaattgggtttattttgg
tttgttttaaagagagtgccacaaacaggaggaaaaagtcaagctagtgggaagcagtgg
gttcagtttgagtctggccagtactggctgacacccactttcattcaatgtttattgagc
atctattatagagggcacttggatatcaataaattaaaaaagatgctgtttctgcccctta
aggagtgtcatagtataactggtgaaacacatattaacca >IGR2228a
cacaaacaggaggaaaaagtcaagctagtgggaagcagtgggttcagtttgagtctggcc
agtactggctgacacccactttcattcaatgtttattgagcatctattatagagggcact
tggatatcaataaattaaaaaagatgctgtttctgcccttaaggagtgtcatagtataac
tggtgaaacacatattaaccacattttaatctaacaacacgctactgaatatacaattac
acactgagtcaagtgcactgaaggatcggcatgcaggttaatgaggcacaaggaagga
agctaccctggactgggggtaagggttggggaactggacattcagggagggtctccttga
tcatgggacactgagatgggaaaaaatagttgacgatggggatttaaggtgtagggacc
aagctctcaatgatattcacagtatagtggggaagaccaacattaatcctataataacac
tttttttcccccaatttctggtagacgttttaaaggaaagtcataaggaactagggatcc
tgaattagccagcatggttaaagaaggccacagggggtgggttgggtgggtgggaatg
cttcagactctgagaagaccacacaccccccatggctggaggggggcatggtgaacatgagg
aaccagtgtggttggcatcaggcgtgcaattcaagagtac TABLE 5-continued

```
>IGR2229a
ggtagacgttttaaaggaaagtcataaggaactagggatcctgaattagccagcatggtt
aaagaaggccacaggggtgggttgggtgggtggggaatgcttcagactctgagaagac
cacacacccccatggctggaggggggcatggtgaacatgaggaaccagtgtggttggcatc
aggcgtgcaattcaagagtacagtggtggctaggaggcaaattgcacaaggtcttgcaac
tatgtggaagagtttggtgttttccctcaataaaagaggttttttctgttgttgttttt
ttttccatcacttgggttcactggcatctaatgagtagaggccagatatgttgttaaa
tattctaaaatgccaggaaaatgccctagaacaaaattatttggctcaaaatgttaata
gggtcgaggttgagaaactctcgcctggtagtagactctactttccctgcatggtttt
ttaacaagcatgttctatatgccaaccaaggggtggttcctaaccacaaggcaggctggt
ataatctctatgccctttccttcctaagagctccctgggatggtagggaagagacagat
ccagagaacccttacatagccagtccttggcagttcagggttggggccagaaatgtt
tgcttttaaagtctgtcaacaaaatggcaaacacacacat >IGR2230a
tgccaaccaaggggtggttcctaaccacaaggcaggctggtataatctctatgccctttc
ccttcctaagagctccctgggatggtagggaagagacagatccagagaacccttacata
gcaccagtccttggcagttcagggttggggccagaaatgtttgcttttaaagtctgtcaa
caaaatggcaaacacacacatacctggaaacaggacacagcagtctacttcttcctagag
ttgtgcatctcttacaagtcagacgcataaagataactcaatagtgttacataaagggct
ttgacaacccaggagtactttaattgctcttgaatttcagacatattcataggccagaaa
gaaggtgaaacctttatactatataaaaagttacattgatgtcctagacaagttagggca
tgaattgattgcttcaggtaatctacttagcttaggttttagaactggtttactcagaa
gtaatgcactcagaagctgtccatcccacagggccctgggccttccaaggggcacagac
aggcttgaggcagggcattgggaattgaaggcaggggctgcaggcagaacagccatactt
ttagccacttagggtgtatttcatttactagacttaaattatcctactttaatgaaagtt
ctgtggccaaaatgtttagaaaggtttgaaaaacactata >IGR2231a
tccatcccacagggccctgggccttccaaggggcacagacaggcttgaggcagggcatt
gggaattgaaggcaggggctgcaggcagaacagccatactttagccacttagggtgtat
ttcatttactagacttaaattatcctactttaatgaaagttctgtggccaaaatgtttag
aaaggtttgaaaaacactatattagccttctgtagactaaggtgtcctaaacacactc
acaaattttgtttccactttcctgggaatagacctttggaacttaaatgctttcctca
ggtaatcattgtgtcacatggcaagaaggttcttaagctgacccatgacacagctgaccc
agaaaaatacactgcatttctactctgaacttggggtatctccttttcacatcaagggca
ttcttctgagccgcagctgtcacttagctccgtgagaaggaatctcccatgtccactcag
gtggcctctaagcatagcacaatcctcccccagttccccctccccctccccactcccctc
tccccaggcaacctcatccctatctggggctctgctgagggttctatatgctgacaaatc
ctacatgtgtttctctagccaaaacctctcatgcagtaccatatccatacagccagcttc
acactctacttctccacttaggggtctcatagtcaccca >IGR2232a
caatcctcccccagttccccctccccctccccactcccctctccccaggcaacctcatcc
ctatctggggctctgctgagggttctatatgctgacaaatcctacatgtgtttctctagc
caaaacctctcatgcagtaccatatccatacagccagcttcacactctacttctccactt
aggggtctcatagtcaccccaaatttagtacacacaaattgaactcaatatccatgaacg
tggttcttttccagcattctctgtcttagagaagtgtaccttcattcacccagttactca
ggccagaaagctttcttcccccaattccgacatccagcccatcggcaagtcttgttgatt
ttacctcttaccacttccctccatttctaccaccgtcatgctaggccatgccaccatcat
ctctggcatgaactactgtgacaaccttttaattggtctctctacaacaccttttgcttc
ccttcaattcttcttcacaaggttgtcaaagcatctttaaaaaaaaaaaaggacaaat
ctgattgtcacactattgctttaaaaaatctcagtagcccaccgctgctctgtggctgaa
gcccaaagtcctaactgtgatccactaagccctggttgctcatctgcccagggctctgcc
tgcctctcccttcatcttaacaccactctccgcacctct >IGR2233a
aaggttgtcaaagcatctttaaaaaaaaaaaaggacaaatctgattgtcacactattgc
tttaaaaaatctcagtagcccaccgctgctctgtggctgaagcccaaagtcctaactgtg
atccactaagccctggttgctcatctgcccagggctctgcctgcctctcccttcatctt
aacaccactctccgcacctctaccacacggactttgtcctgctcccatgccttttcatga
gccccggctttagcacttgctattctccctgcctggatgttctttctcctctctacccct
cagctggctactttcgactcatcttcccactctcgctcatgcttcaccttctcagggatg
ctgccctgacctcctctgttagacactcctgtggcaccctgcacttctctgtatctctt
accatgccaaggacaacaacgacttcctcacttggttgtttaatacattccaccttgct
agaaagcaagttttaggacagcagggacctagaacagtagtccatacacaatagaggagc
aagactacctgggtccaaatcctgccacttgccagctgtgaaaccttgggaag
ttatttaatccctctgtctcactttctccatctgtaaagtaggaataataaacaggttaa
cctgcttttaaaaaaaaatctggctgggcaggtgcagtg >IGR2234a
agcagggacctagaacagtagtccatacacaatagaggagcaagactacctgggtccaaa
tcctaactctgccacttgccagctgtgaaaccttggggaagttatttaatccctctgtct
cactttctccatctgtaaagtaggaataataaacaggttaacctgcttttaaaaaaaaa
tctggctgggcaggtgcagtggctcgcgcctgtaatcccagcactttgggaggccgaggt
gggtggatcacctgaggtcgggagtttgagaccagcctgaccaacatggagaaaccttgt
ctctattaaaaatacaaaattagctgggcatggtggtgcatgcctgtaatcccagcaact
caggaggctgagacaggagaatctcttgaacctgggaggcagaggttgcagtgagccgag
atcgtgccattgcactccagcctgggtaacaagagtgaaactccttttccaaaaaaaaac
```

TABLE 5-continued aacaacaataaaaaatatctggctgcgcatggtgtctcacgcctgtaatcccagcacttt
gggaggttatggagggaggattgcttgaggccaggaattaaaaaccagggaagatgctgg
gactcctttccaccggctaacccaccgatttgtggggtgttctcacatgtgccatgtggc
caaggacttgctgaaggctgctactctcttcacagtcttc >IGR2235a
tggctgcgcatggtgtctcacgcctgtaatcccagcactttgggaggttatggagggagg
attgcttgaggccaggaattaaaaaccagggaagatgctgggactcctttccaccggcta
acccaccgatttgtggggtgttctcacatgtgccatgtggccaaggacttgctgaaggct
gctactctcttcacagtcttctctgacagaccctgaagctccagggaaagaagacacaac
ataatggaccectctaagaacttcatgaaagctacggacctctctccaaaaaaatgctca
catgtagtctctaacattgtgcatataatttcgaggggtttgggattctctaagccgtta
atgtttccttgagttaaaagctttagaattatacaaataacctgcttataagaaatggat
caaaacactattctccctcctgtcataaagtaaatgccaaaaccacaggccacttagcta
aggggcatcagccttgtggacaaaagagttctgcttttcataccactagtggctggtgag
agctcctttcactttgcagagagaatgctggtcttcttgggactacagaggcagacaccg
tggcactactacagatctacaatctagcacatgtgcatgtgtgcatgatgtcaacctctc
ccatgctcaggggcatgacagagtcacagtgacccagggg >IGR2236a
acaaaagagttctgcttttcataccactagtggctggtgagagctccttcactttgcag
agagaatgctggtcttcttgggactacagaggcagacaccgtggcactactacagatcta
caatctagcacatgtgcatgtgtgcatgatgtcaacctctcccatgctcaggggcatgac
agagtcacagtgacccaggggaggcaagccaggctactgcagaagtgaatcatggcatat
tacctagtcaaccggatcacagatacattcagcttagacagctcaggtttctttacttag
caagaattacggagtcagatgatttgttggctcttcttactaggcatggagtctatatca
cagacatagcttcctcttctttaaaatacagggccctgcgctgaaagaatactaccaact
gaaatcaagggccaggcacacgcttcttcctcagtgctgaggtccctggtgctccagaa
gacagacaccttacctgtctgacagctgccctgaaatgaaggagcccaacagcacaccca
cgaagaacaaggagattgtgagtggggccttccagtcgtcctcacacaccaggttccact
gcaagatgagcaaaggggtgtatcattcacttcttttaaaaggttttaaagcaaaggc
atcctggaaaatgaagtcagaacatcctgccatccccaca >IGR2237a
tgacagctgccctgaaatgaaggagcccaacagcacacccacgaagaacaaggagattgt
gagtggggccttccagtcgtcctcacacaccaggttccactgcaagatgagcaaggggg
tgtatcattcacttcttttaaaaggttttaaagcaaaggcatcctggaaaatgaagtca
gaacatcctgccatccccacacgctctgagtgtgaactcacttagtcaggtgatggctca
cctgggcaggaaggcagagagcaggcttctttcccatcctgtttttcatagcattgtagg
ccccactgtcttgcttccattttgaggaggagagacaggcagagagtaagtgttctgtcc
acatgctgaccctgagaaagcaaggcctctaacgcttgctcctaaaaatctgagcggag
cccagggctgtggaagaggcagggcaccctcgctcagtggggttcaggccattggcatga
acgtcactggagtggttctggaagcagggctctgggctctacgggccaaagcatccagc
aagaaactaaggccagggcacagagtgcaccatctggacctgctctgctcaggttcccac
cctgggccaatgaccccgggtccttttttgtgacctttagagctggaatccctgatgctg
cacaccaactatactaggctcaattacagctgaaagccct >IGR2238a
ggaagcagggctctgggctctacgggccaaagcatccagcaagaaactaaggccagggc
acagagtgcaccatctggacctgctctgctcaggttcccaccctgggccaatgaccccg
ggtccttttgtgacctttagagctggaatccctgatgctgcacaccaactatactaggc
tcaattacagctgaaagccctgagcttggaggtaagaaactgggttttagctcccactct
actattaactcttccaacctcagataagcatcaccccatgctgtgccttgatttcccat
ttgtaaaacagggattggggtaaggaataggctgcaccgcttgagtttccagcttccaat
gtgtggttccatctatagttaccatgaacagaaaaagaggtctgaagacatggggaagca
gccagacgcttggatctggctacgcctgcctaaacaagagccaaaagcaggaagaaagcc
caaacgggaaacttagtggttcacagaaaaatgaaaatgtttttcagacagagagatgg
tgctcagtagtaacctttgcagacttctcacatgagcaaccaccctcctaggaactcaga
cccttgcctccctggtgccaggctgctagcctgccctccacggagcctgctggctcctca
ccaacaacgcaggcaaggggacatgcggctccctagaaca >IGR2239a
ttcacagaaaaatgaaaatgtttttcagacagagagatggtgctcagtagtaacctttg
cagacttctcacatgagcaaccaccctcctaggaactcagacccttgcctccctggtgcc
aggctgctagcctgccctccacggagcctgctggctcctcaccaacaacgcaggcaaggg
gacatgcggctccctagaacaaagcatctcttccaagccagtgacaggaaaaacaagcc
tgcttctccgcactgctgggcagtgtgggcgcacagcctccgggcacctctcagagggt
tggcaggcaaccctcaggctggacacggagaactcccgcagcaggcacactgctggtgct
ccgctttggaataagcgtgaacctggatgggctgggagtagggtggcaatccccaaccca
gggaagaactggagcatccaaccctaatcaggaggcagcccagactagcaggagtcaag
aacatgggaggaccacagcctgactgcccaggctgccacagccctccaacctccacagcct
cagaagggccagcacccacaggccatctctctggtaggtgggtaagtatccctgcagtgg
ccccacccacacatggctgctaaatctaggactgggagtggaggcggagaaaaagctga
gggaattgatgacagggtgccggcctctgtgtgtgaggcc >IGR2240a
ctgactgcccaggctgccacagcctccaacctccacagcctcagaagggccagcacccac
aggccatctctctggtaggtgggtaagtatccctgcagtggccccacccacacatggct
gctaaatctaggactgggagtggaggcggagaaaaagctgagggaattgatgacagggtg TABLE 5-continued ccggcctctgtgtgtgaggccaagcttcaggggccaggacctggctcctgccactcttga
gtatgatgggctctatttcccagctagcatgtcttttatagtggaaaagatgaaaacatg
aacaaagggtcagcagcggtttctcacaggactatcatgaggtgagggttgggacccat
atggctgagctagactagcaatccacgtgggcttctgcagtgagttctggggttgtagac
cccaggacaggtctcccaatatcaggcttctaaagactccttggctggcaaggttgggtg
tgacctaaaaccaggtcagacaatctctgcagggacagggtgactatagtgctcatttt
gagacaggccccagagcatctctcaggctcccttagccccaccctctctacttggtccag
cctgtccttagtctaggcaggtgtgtaactccttggttaactctgccatccacccaccac
tgaccgcccttgacaactctctgggcctggctttgggccc >IGR2241a
acaatctctgcaggggacagggtgactatagtgctcattttgagacaggccccagagcat
ctctcaggctcccttagccccaccctctctacttggtccagcctgtccttagtctaggca
ggtgtgtaactccttggttaactctgccatccacccaccactgaccgcccttgacaactc
tctgggcctggctttgggccctccaaaagcaaatatgcattaacacttctttcctattgg
ccgcagggggtctgtgagcaggatcaggaaaggtgctaggtctcaaaactgaacacaagg
gcaaacatagattgggtcccagcctgccaatccgtccacatatctgtcaaccaccagatg
gactgcagtaggttccaggacttggccagaatctccctgagaagaggtggatgagaagca
catagagtccaggctaagtacccctacttaaattgtttacaaaggagtctagcattcct
tagctcctggctccccagctgtgattaaagctgctacagaccagcttattgatgcctccg
cctggcacatgggatgggctatactggctgatgatcacaggtatcaatgttaaaatggaa
tgtgtgggtttaagatttgggtcacgagtctaatgctgtcacccttcagctggctgagct
gtgaatgcaggcccaacctgaaaacaatctgggagcaact >IGR2242a
tgtgattaaagctgctacagaccagcttattgatgcctccgcctggcacatgggatgggc
tatactggctgatgatcacaggtatcaatgttaaaatggaatgtgtgggtttaagatttg
ggtcacgagtctaatgctgtcacccttcagctggctgagctgtgaatgcaggcccaacct
gaaaacaatctgggagcaactctggcaaagggctagacttgccccctcttcctggggaga
aatgcacctttctagtggtgatggtttcaagggtgtagagatacatgtgtgccaaattgc
atgcttagctacatgcagtttttatgtcatttacaccttaataaagctattaaacattt
ttaaaaagagggagaattgtgtctcctatacctcatacataattggcactgcttttttcag
ttatgagaagtagagagatgacatagttccctgggactaaatgttcttacctgtgaattg
gcaggaagggaaaaaagatagggtgtgtgccccctaagacagaagttcttccctgagggga
tgtacctagcctgaccgtatcaacagtcagacatgctgctaggtaccacatgttactgat
tgccatgtattcctatattcctacacacatttttatcctgcctcctgctgaaatcaatgat
gaatccttgccccaccgttgtcagagcaaagagaaaaggt >IGR2243a
agggtgtgtgccccctaagacagaagttcttccctgaggggatgtacctagcctgaccgta
tcaacagtcagacatgctgctaggtaccacatgttactgattgccatgtattcctatatt
cctacacacatttttatcctgcctcctgctgaaatcaatgatgaatccttgccccaccgtt
gtcagagcaaagagaaaaggtatttcctatctttgctatcacatcctctacaactcctgg
cagtgcccctgtatcgaagagaggctcaggagctctttggtacataggtgagtgaatga
atcgataaataaaaaggtatcaaccttcaacatcttggtatactttagttcttgcttggc
tgcccaaagtcgagatgaacctgaactcctgaacttcaatctccagaatactcttttttt
ttcttttgaaacagagtcttgctctgtctcccaggctggagtgcagtggcacaatctcgg
ctcactgcaacctccacctcccgggttcaagtgattctcatgcctcagcctcctgagtgg
ctgggactacagggatgcaccaccagcctggctaattttttgtattttagtagagacgggg
gttttgccatgttgaccaggctggtcttgaactctgacctcaggttatctgcccaccttg
gcctcccaaagccctgggattacaggcaagagccaccaca >IGR2244a
cccgggttcaagtgattctcatgcctcagcctcctgagtggctgggactacagggatgca
ccaccagcctggctaattttttgtattttagtagagacggggttttgccatgttgaccag
gctggtcttgaactctgacctcaggttatctgcccaccttggcctcccaaagccctggga
ttacaggcaagagccaccacacctggccatttttttttttggctccctgaccccctgctt
tgtgtcaactgtcagaaatttgacccaggatgacaggtgtcagctagcagagagtgct
caatctgaccactcatggccagatgtgtctactatgtacgtgcatagtgggccacgggac
cccgcaagtggcttctctgccttgccatatagctgcaaaaggctggatgagggtctgtgt
gtccctgagtgagagaaatcaacaaaggcgtaacagtgaggttcaagttccaggtctct
cgggtctctgctgcccagagtcagcccggtcccagctcccaggttgctctggcttttcc
tccaggcagctttggggataacagtgagggctctctcatcttctaagactatctgtctct
acacaagataaggctgatagaaaagctagtccaggacaatggggagggagtgggagtccc
acccaggactgggccgagggcttcttagaagcagacaggt >IGR2245a
gtcagcccggtcccagctcccaggttgctctggcttttcctccaggcagctttggggat
aacagtgagggctctctcatcttctaagactatctgtctctacacaagataaggctgata
gaaaagctagtccaggacaatggggagggagtgggagtcccacccaggactgggccgagg
gcttcttagaagcagacaggtggagacaaggcgatgcagagcagcttggaagttttcttt
tcttttttctttttttttttttgagacggagtcttgctcttgtcacccaggctggcatgca
atggtgcgatcttggctactgcaaccccacttcccaggttcaagaaattctcctgcctc
agcctccctcccgagtagctgggattacaggcacccgccaccacgcagggctaatttttg
tatttttagcggagacgaggtttcaccatgttggccaggctggtctcgaactcctgcctt
gtgatccacctgcctcagcctcccaaagtgctgggtttacaggcatgagccaccacaccc
agccggaagtttctcaaggaacctgtctgtccataggctggacagagctatggtgaaacc
aaagagcggacagcccagacaacctcagaaacaacccaggtttccagcagatggggcagt
ccatggccaagaagcactgcatgatgggttggctaattcc TABLE 5-continued >IGR2246a
ctcccaaagtgctgggtttacaggcatgagccaccacacccagccggaagtttctcaagg
aacctgtctgtcctataggctggacagagctatggtgaaaccaaagagcggacagcccaga
caacctcagaaacaacccaggtttccagcagatggggcagtccatggccaagaagcactg
catgatgggttggctaattccccagtaccccaggatgactgaggggccagaggagaggc
cagccgagaaccatgtggaccaccaaactattcctggaacatgggggcataaaactcttt
tacctcataaatcattttttatttattaatattattattattcttttgagatggagtctcg
ctttgtcgcccaggctagagtgcagaggctcgatctcggttcactgcaaagcccgcctcc
tgggttcaagcgattctcctgcttcagtctcccaagtagctgggaatacaggcatgtgcc
accacacccagctaattttttgtattttagtagagatggagtttcaccatgttggccaga
ctggtcttgaactcccgacctcaagtgacctgctgccttggcttcccaaagtgctgggat
tacaggcgtgagccaccacgccctgccaatatttatttatttattaattgctagcagatt
ccctctgccaatcccaacacctcattccacatccatgtgg >IGR2247a
tgtattttagtagagatggagtttcaccatgttggccagactggtcttgaactcccgac
ctcaagtgacctgctgccttggcttcccaaagtgctgggattacaggcgtgagccaccac
gccctgccaatatttatttattaattgctagcagattccctctgccaatcccaaca
cctcattccacatccatgtggcatcaaagcccccagtcagtgggcaggggagtcacattt
cctttaaaaaattccagtcaatccttttcagccaccctcaagtttcccttctaagaactg
aactattttctcttagttctcaaacttttagagatgatttcttaaattattcattaactca
ttcaataaaaattttcctgagaacctccctctgcatccagaattgtgtcagaaattgagg
aagacgcaaagatctaaatccaccacaaagtttggtactacatgtatgtactttaacttg
aacaaattaaaaaaatccaaacaggacacctgaggttccagtcttcagtggaaaaaatat
gactagtaattcaataccagtgtacttacaaacacctttatgtatgatttggggcagagg
gcaggcttagagacatttagcaggcatgggactagatgcagtgttcagcaggccaggttt
gggttgaaagacaacaggccatagaaaaagccattagaat >IGR2248a
aacaggacacctgaggttccagtcttcagtggaaaaaatatgactagtaattcaatacca
gtgtacttacaaacacctttatgtatgatttggggcagagggcaggcttagagacattta
gcaggcatgggactagatgcagtgttcagcaggccaggtttgggttgaaagacaacaggc
catagaaaaagccattagaatgttgatgcagcaacttccagcagtagctgttcacctggg
aacaagcagctctgaacttcaagtcaagcattccagtagcccaaaacaaagatctaagca
ttaatctggcctccctgcaaagactgacaacatataagtaggtgaaagggcacataactc
ctttgaaactgctaagacagctaaataaaatagtctaaatattaaaaaacaaaaggctgac
attggcagcaagataaggtcagaccccctggcacagctggcctttgggagctcatcaatg
ccaccatcactcagcccaatgtgggatggaggcagcaaagcaggaacaagtgactagagt
aagccggggaaccctcaggggtcaatgtaaaactccaagagatgccatgtgcttcttctt
gcttcactacttccctcttctttaggcagccccaagtagaatttgtagggattcctgtgt
catgttcccctctgtggcctctgcctgcaacctcagggac >IGR2249a
tgtgggatggaggcagcaaagcaggaacaagtgactagagtaagccggggaaccctcagg
ggtcaatgtaaaactccaagagatgccatgtgcttcttcttgcttcactacttccctctt
ctttaggcagccccaagtagaatttgtagggattcctgtgtcatgttcccctctgtggcc
tctgcctgcaacctcagggacagcctctgctttcatagtactcactggcttccgggaagg
taacacacccacctgtgaggctaggacccaggatttgtggcaactgaaagttccaatttc
ctgtggattcatgggccagaaagcacagttggctacctccaaggagtgcctcttttgtca
agccatgatgcctctgacactgaagctatgtcactagctaagaaatcccagtggggctc
cggtcacactcccactacatatatgtggagaaagcaggtccaaatgctggggacatcaaa
tttcaaaaagaaaaaacacacacatgcacacacacttggatctcccagggtagctctca
gactccattgaagggtgatgacgccaagaagcaacacagttgggatctccagagcccctg
taagcccctctgaggctccaggaggggaggctcagcaccaacatccagcagggcttgaag
ctgtgccagggcctgtggcactctccctctctatgaactc >IGR2250a
cacacatgcacacacacttggatctcccagggtagctctcagactccattgaagggtgat
gacgccaagaagcaacacagttgggatctccagagcccctgtaagcccctctgaggctcc
aggaggggaggctcagcaccaacatccagcagggcttgaagctgtgccagggcctgtggc
actctccctctctatgaactctcccctctctgtgaactccgccgtcctgctgggtggttt
cttgctgctgcattggggccttcagctcactattatgctgagctgaacacacctaggctca
ctgagaggcctcctcttctgggaagccttctctaacctgcgaattggtcatctgcacatt
tagtgagcctatctatcaatgagggctactcactggctacttactcaatgctgctgaaac
ttcagggagctagagtgccagtgtctaaaaaagacacaaaacacatacatcattaacatc
atgttcctacatccagctccaacaactgctccaacaggttcggagggggacagacaaaacc
acccagagggaaaatcaagggggatgagaaatgagaaaggctcccccacacccctatgacc
taaggctgtatgctttaactaaatctggccgacagccttgcctcataatacctgagaaaa
tattccaggtcaacaagtcaccctgaacccatcttcagat >IGR2251a
caacaactgctccaacaggttcggagggggacagacaaaaccacccagagggaaaatccaa
ggggatgagaaatgagaaaggctcccccacacccctatgacctaaggctgtatgctttaac
taaatctggccgacagccttgcctcataatacctgagaaaatattccaggtcaacaagtc
accctgaacccatcttcagatgaatggatcttaaagagtgacaactgacggcctggcgtg
gtggctcacggttgtaatcccagctttgcaggcagaagcaggcagatcacgaggtcaaga
gatcgagaccatcctggccaacacggtgaaaccccgtctctactaaaaacacaaaaatta
gctgggcgtcgtggctcacagctactcggaggctgaggcaggagaatcacttgagcccgg TABLE 5-continued aaggcgaagattgcagtgagccaagaacgcacgactgcgaaggttgcagtgagccaagaa
cacacgactgcgctccagcctggtgacagagggagactctgtctcaaaaaaaaaaaaaaa
aaaaaaagactgacaactgaccatgggaaaaggcaaacaattacttacagggcatgacca
gattgtcgttttttgggttgtggacggtaggggaaggagtaactagaggaaaaagggaaga
ggcagttgtatacacatgctttatttaacttttaaaagtt >IGR2252a
ctggtgacagagggagactctgtctcaaaaaaaaaaaaaaaaaaaaaagactgacaactg
accatgggaaaaggcaaacaattacttacagggcatgaccagattgtcgttttttggttg
tggacggtaggggaaggagtaactagaggaaaaagggaagaggcagttgtatacacatgc
tttatttaacttttaaaagttcaggaaagagaagtatttcttctcttctaaaagaaatc
aagagactagaggaaaaacgggatagcccctggcccaagtcctggctctgctacttacca
ccccaaccccaactagagtaagtcctggacacacagggccatagagcatcgcccaggga
ccgccaggaccttcctggtaccctcttcaaagtggccatcaggacgggaggccagactga
ccacctgtgcagggaggagcacactgtggctggaggtcacctcgtgaagcgttcccaagc
cacctggctggagggtctccatcgctagggtgttgaccgttgggggaggggagtgacag
cgtccagtgcgcatctgggagagaggagctcgggttcaaggaccgcgacaggtcctccga
gccctggtctcagcccagcagggccggcacccacctcggtcacaatggtggacaggta
gacgtcctgactgaactcccagccatccagacagctctcc >IGR2253a
catcgctagggtgttgaccgttggggagggggagtgacagcgtccagtgcgcatctggg
agagaggagctcgggttcaaggaccgcgacaggtcctccgagccctggtctcagccccag
caggggccggcacccacctcggtcacaatggtggacaggtagacgtcctgactgaactcc
cagccatccagacagctctcctgctccagctgccccaggtccacgtcgcgccccggctcc
agcccgagcgccgagaagttggcgatggtggcgagccggtagcggcggcagctgtgggc
acctcgcggccgtcccgcagccgcagtgggacagtgtggttgcgccaggcgctgctcagg
ttcgcggcgtccggcacccggcagcggtgctccggggtcgctatcaggaacacggaggac
aggccggtgaagccattggggatgatgctggcgctgagcaggaagaagatgaggcgctgg
aagggcccccactcgcccaggaaggcggtcacctcgtcgtagtcccgcatgccgccctca
gaggcccacagagcgcggcctgggtctgggaacgcggcgggctttgcgcgtgcgcgcgg
ggcacccgccgccaccaggcaagccaggcagcaggcgacccaagaccgtccgcggaggg
taggctcgcgagctgacaccgccgccttggtcctgccgcg >IGR2254a
ggaaggcggtcacctcgtcgtagtcccgcatgccgccctcagaggcccacagagcgcggc
ctgggtctgggaacgcggcgggctttgcgcgtgcgcgcggggcacccgccgccgaccag
gcaagccaggcagcaggcgacccaagaccgtccgcggagggtaggctcgcgagctgacac
cgccgccttggtcctgccgcggctggccttacatatggcgcacgaccagggaaggttccg
ggcctgggccgcaaggcgcgccccgctggcaggcagagcggcgccggcgaaggcggagct
ggggcgggacgcgaggggcgcggggcgggccgggagtgcacctgaggcccggcggggcct
gtcctggggacctggcgaggcccggcctctgccagccacgcctgctgggacgaccgagg
tagcccggggtcggcttaggaaggcagcgggactcgaggccttggggtccgagtccgaac
tcgctcctctagcgccgggcggggagcgagtgggagagcggccgcgaagctccagtgttg
aaaacgcaccctcccagcttttttgcaaggcctacttgggggcggaggtaaggagaaagt
cactggcccagggtctcacagatagttgctcttgacaccgcctaatcttataagagggac
ggggattattttgaacctgggactgttaactaccctagta >IGR2255a
cggggagcgagtgggagagcggccgcgaagctccagtgttgaaaacgcaccctcccagc
ttttgcaaggcctacttgggggcggaggtaaggagaaagtcactggcccagggtctcac
agatagttgctcttgacaccgcctaatcttataagagggacggggattattttgaacctg
ggactgttaactaccctagtagagaggctgggagctatgacttttcattctagtccagat
gcccttccacattttcgtctgtaacaagccattttgttcatgcagatgtaaaaatttaa
cttcacgattaacgatcctagcctaggttaaatattccccacagattagttatttccgt
gcagagtttattcagaagctaactggaaaaaaaaaaaagcagcgaggtgattctaaagc
agcaatgttccataggataaggagctacatttgttatgttaacttttctagtagccatat
taataaaattgccagatttagcaaataaaaatataggactcctagttaaatttgaatttc
agatatagaatgaataattttaaatattatgtcccaagcaggaatatataaaataaaaa
tgtaactggttgtcctgtattttattgggcaatgctgcatatttaaaaagtaaaaataaa
agatgaaattaactttagtggtatatttaatcaagtatat >IGR2256a
agcaaataaaaatataggactcctagttaaatttgaatttcagatatagaatgaataatt
tttaaatattatgtcccaagcaggaatatataaaataaaaatgtaactggttgtcctgta
ttttattgggcaatgctgcatatttaaaaagtaaaaataaaagatgaaattaactttagt
ggtatatttaatcaagtatatccagaacatgatcatttcatcatataatcaatatagaaa
ttattgatattttacattgttatatgtaaatcattgatctttttttcccctcctcatact
aaatcttaagaattcagtgtgtttcacaggttctcaggatttgaaaaaaaaaaaaaagg
aatccagtgtgtatttacagcacatttcaatttggactagccacacttttttatttttta
atatttatttattcatttatttattggagacacggtcacactgtgtcacccaggctagag
tgcagtggcacaatcatagctcaccgcagccctgaactcctaagcttaagtgggcctcct
gcctcagcctgctgagtagctaggactacaggcacatgccaccgtgcccagctaatttttt
ttattttttttttattttacagagacaaggcatccctgtgttgcccaggctggtctcagact
cctgggtttaagcaatcctcccacctcagcctcccaaaat >IGR2257a
ctcaccgcagccctgaactcctaagcttaagtgggcctcctgcctcagcctgctgagtag
ctaggactacaggcacatgccaccgtgcccagctaatttttttatttttttttatttaca TABLE 5-continued gagacaaggcatccctgtgttgcccaggctggtctcagactcctgggtttaagcaatcct
cccacctcagcctcccaaaatgctgaattacagacgtgagccactatgcctggccagact
cattttttaagtgctcagtagccacatgtagctattggttatcttattggacagcaccat
tcctaaggcctttaagaatttgggctgctaaacttaacaatgcaagatattccttttttaa
aatagtagtggcttagtgatagaaacagaactaagtgtatattttttacaatataatgtgt
tgggtaaagaatatttaatagtcactatattatgagttgaaaataaagctacagaagggg
aacctaacctggccagcagattttttaataaggaaatctaaacatttgcataaagcataat
agacttaaaaaaattatgataaagatgttatcacaggacttgtttgtttcttttatactta
ctattcactattcttacttcgtgaagatggatggttataccttcagcaatgtacttaaat
ccttctaacatcttatgtgaagttatagttcttatctaga >IGR2258a
attttttaataaggaaatctaaacatttgcataaagcataatagacttaaaaaaaattatga
taaagatgttatcacaggacttgtttgtttcttttatacttactattcactattcttactt
cgtgaagatggatggttataccttcagcaatgtacttaaatccttctaacatcttatgtg
aagttatagttcttatctagaactaactgaaaaagaaagcaaagcttcttgaaaataaac
tccttttttgtgtgctaaaatattattttaatgcttcaaaagaaatgaaagcttttatga
gaagaatgttgacctctgtccagaccaaacaagatgaagaagtcttattttaacatttga
gaaatatcagttgggcatcagataacattcctgaaagggactgaaaacaatgcagtatac
tacaaaagaagctgcatatccttaggaagaaaagaaactatttgtcatagatggcttgtc
cacatgcgcaaagcagagagcaacctaagatggtgccgtccagttccaggtgcactgtga
ttactatctgaatgccattactatttaaattgcatttttttttttgagacagggtctcctt
ctgtcacccaggctggagtgcagtgaggtggtcttggctcactgcagcctcaacctcctg
ggctcaagcaatcctcccacctgagccttccaagtgcctg >IGR2259a
gcaacctaagatggtgccgtccagttccaggtgcactgtgattactatctgaatgccatt
actatttaaattgcatttttttttttgagacagggtctccttctgtcacccaggctggagt
gcagtgaggtggtcttggctcactgcagcctcaacctcctgggctcaagcaatcctccca
cctgagccttccaagtgcctgggactacagccacgcgccgctacacccagctatttttt
tgtattttggtagagacagggttttgccatttggccaagctggtctcaaattcctgac
ctcaagtgatcccccgtcttggcctcccaaagtactgggattataggtaggagccacca
tacccagccttaaatttcatcttttaaaagagaaagagagcttagaatcttaatcagtta
cctgagggccctttatcctgcaatattctgaattgggatgttcctattttacatattaaa
aatgtaaaactgatttatatggtagataaccctacagttcagggctagaactttagatta
aatgcattcataccctggcagatgtggtagcttgcctccaagatggcacccaatgaatga
tccctgtaccaggattggtctatgtgaccaaaagcatacagcattagtgatgatacttat
atcacttgggtaattacattataaaagatgtccatcatgg >IGR2260a
tggtagataaccctacagttcagggctagaactttagattaaatgcattcataccctggc
agatgtggtagcttgcctccaagatggcacccaatgaatgatccctgtaccaggattggt
ctatgtgaccaaaagcatacagcattagtgatgatacttatatcacttgggtaattacat
tataaaagatgtccatcatgggtgttcttttcccttctcttgctcagagacaagcaagc
tgtcatgttataagcagccctttgagggggtccatgtgatgtcaaggaatgaagtctctag
ccaacatttaatgaggaactgaggcccaccaacaaccttgagtgagcttggaagtagctc
cttcagcatcagttgggtgtcgagatgactactgacagcttgactgcaacttcatgagag
tcttctggaccagaaccactcagttaagtggctcccagattcctgatcctcagaaactct
gagaaataatgaatgttggttgttttaaaatggtaaattttgaggtattatgttatgtgg
caatagatagctaatatataaattatttgaatcaaacaatacgttaaattaaagctcaga
agaataaacatctgtaattccttaatttgttttcccttctattctacagaatagaattttt
acagatgaaccttgtagttacttgtgcaataagagacagt >IGR2261a
ttgttttaaaatggtaaattttgaggtattatgttatgtggcaatagatagctaatatat
aaattatttgaatcaaacaatacgttaaattaaagctcagaagaataaacatctgtaatt
ccttaatttgttttcccttctattctacagaatagaattttacagatgaaccttgtagtt
acttgtgcaataagagacagtatgttgtattgattaagtgcagagcctctggatgtatga
tagaagaaagaccaatattcaattgctttcttcttcaattccaagcttgtgagcttgagc
aaattttaaaagtgttttaagcctcagtttcctgggatggtagtgcttagctcgagctcc
tagcatatattaactacaaactaaatattagctataattattagttttactttgattatt
gactctaaataaatacctttaagaactttgtgttctccacagattttggatatgtctggacg
ttatgtaggctggagtagtcagcaattacttgcctgaggaagggaaggcctcctcctttta
agaaaagaataggctgggtgcggtggctcatacttgtaatcccagcattttgggaggctg
aggagggtggatcacctgaggtcaggagtttgagaccagcctaaggaacatggtgaaacc
ctgtctctactaaaaatacaaaaattagccaattgtggca >IGR2262a
cagcaattacttgcctgaggaagggaaggcctcctcctttaagaaaagaataggctgggt
gcggtggctcatacttgtaatcccagcattttgggaggctgaggagggtggatcacctga
ggtcaggagtttgagaccagcctaaggaacatggtgaaacctgtctctactaaaaatac
aaaaattagccaattgtggcacggcgcctagtcccggctactcaggaggctgaggtgag
aggattgcctgagcctgggaggtggaggttgcagtgagccgagatcgcgccactgcactc
cagcctgggcaacagagtaagactccgtctcaaaaaaaaaaaaagaaagaaagaaaga
gtagaaggcccaagcttagtccaatattatagcttcagcatcagagtagagaatgattca
gagcatctgtccagtgtctgctgtagatccctcaaatccgtgtttggacgcttctggtaa
gggtgtatggcagatgcacccgacagatgcacttggcagcaataacttatgcatacctg TABLE 5-continued aagaatgaccctatggtctaagaagaatgtgtgttcagagctccaagctaaggaatctgg
gagtggccaacccagatatttcatttcttatctatgacgaacttctgaactgctcccacc
cccagcccatcctgtagaatgcaggccctacgaggcgatc >IGR2263a
cccgacagatgcacttggcagcaataacttatgcatacctgaagaatgaccctatggtct
aagaagaatgtgtgttcagagctccaagctaaggaatctgggagtggccaacccagatat
ttcatttcttatctatgacgaacttctgaactgctcccaccccagcccatcctgtagaa
tgcaggccctacgaggcgatcaaagccctttgttttaggttaaatgaaggttgcctggtg
gaggttgctaggggaaaggtgttaagtaaaaatgttatataaactgcatggtgtttttg
tttgtttttgtttttttgagacagagttttgctcttgttgcccaggctggagtgcaatg
gtgcaatctcggctcactgcaacctccgcctcctgggttcaagtgattctgctgtctcag
cctcccaagtagctgggattacaggtgcccaccaccaggcccggctaattttttgtattt
agtagagtcagggtttcccatgttggtcagcctggtctcaaactcctgacttcaggtga
tccacctgcctcagcctcccaaagcgctgggattacaggtatgagccaccacgcctggcc
aattgcatgcttttacaaggagttttggttctcctgcccagcccactgccactggactg
ccctgtattgtaagtcccctcaataaaccttatgtctcag >IGR2264a
catgttggtcagcctggtctcaaactcctgacttcaggtgatccacctgcctcagcctcc
caaagcgctgggattacaggtatgagccaccacgcctggccaattgcatgcttttacaa
ggagttttggttctcctgcccagcccactgccactggactgccctgtattgtaagtcccc
tcaataaaccttatgtctcagtttctggttctaggtctcttcttcagcctcttgaacatg
gtgccatccctactgaagtcaatgggtctgacatgactaggggaacttgaacaaaatct
gaaatagctgttttttgttgccaaaatcactgtaagacattatttgcctcagccccaga
acattgaattatatgacccaagagtggagaaacagagaagtctgtctgtgtcatcagaca
atatcccaagtgggatgtcatcaccccaatgcatattggcatttgggcagagtagagcag
cgtcagcctagcaagacttggcacaattctgttggattgcacaatagaatgagaaatcac
atttctgctgttatgtgattctgcattttaactccagtttgtttggcctggacagacagg
taactagccatgaagacaatggaccttgaaacattctgaagactagaaaaagtatgtaat
aaaatactttgaacaactgtttaaggacttaaatgtccag
>IGR2265a
ggcacaattctgttggattgcacaatagaatgagaaatcacatttctgctgttatgtgat
tctgcattttaactccagtttgtttggcctggacagacaggtaactagccatgaagacaa
tggaccttgaaacattctgaagactagaaaaagtatgtaataaaatactttgaacaactg
tttaaggacttaaatgtccagactgtttctttagatgagtgtaatttccaatgtgaaacc
ccacaattcggcttcaagaggtacaggacagtttttgaattcccacagaaaaaattttgca
ttgcaacaaacttgaccatcctatttgtggtagtagaaatgtaaattcattcccctcaga
gatacctgcaaaaatgaaatgtgaaatattctgcttgcattttaaagactggttattgca
ttctagaatagatggaaaagacattagtgagggccaatatagaaatatgagttttcccaa
aagacttttatgtatatatatgacatggcaggaaaattgggtcactagtggttttactt
cttcgttcatttggcaaacatatgaatagactgatgtgtgccaaacactgttccgagttc
tgggaactgaggaaagaaacaagctatctgttttcatggagctcgtattttacttggagg
atggagaggctgacaataaacttgtacaaataaatacaaa >IGR2266a
atgacatggcaggaaaattgggtcactagtggttttacttcttcgttcatttggcaaac
atatgaatagactgatgtgtgccaaacactgttccgagttctgggaactgaggaaagaaa
caagctatctgttttcatggagctcgtattttacttggaggatggagaggctgacaataa
acttgtacaaataaatacaaacttcaagtagtggtaattgccaaggtgaaagaaaagaga
gtaatggtatagaatgacagtcattgggtagctgctttagatgaatggtaagtgaacatg
tttctgagaaagtgatatctgagctgagaggcaaaggacgagaaggaatctgtcatgtga
agatctgggaagcaggtgtactaagcagaagagcagcaagtacaaagactgtgaggtaag
ggatgtgctcggggtgactaagtaacggagagaagaccagcgtgactagaacatagtgat
caaagtgagtaatgttggaacataagtcagagacattggcaggaggccagtttttatgga
agccaaattgtctagtgccttgtagatagtggcaaggagtttggattttattctagatgg
aacactaccagaatattttttcttttttgagacagggtctcactgtcacccaggctggag
tgcagtggcatgatcttgactctctgcaacttctgcctcc >IGR2267a
acataagtcagagacattggcaggaggccagtttttatggaagccaaattgtctagtgcc
ttgtagatagtggcaaggagtttggattttattctagatggaacactaccagaatattt
ttcttttttgagacagggtctcactgtcacccaggctggagtgcagtggcatgatcttga
ctctctgcaacttctgcctcctgggcttaagtgatcctcacacctcatcttccccagaag
ctaggactacacgcaccacacctggctaattttttgtattttttgtagagatgggattttg
ccatgttgcccaggctggtcttgaatgctgcccacttggcctcccaaagtgctaggatt
ataggtgtgggccaccgtgcctggcctatcagagtattttcaggcagagaaaagcataag
gtcttacttctagcataaaaggaacattctggctgctatatagaaagggactgtagagg
acaagaatgaaagcaggttgactgattagaaagcattgcagcattataggcaagagctta
tgatggcctgaactagagtggtaactgtggaagagataaatggatgaattcagaatatttt
ttggaggaaaaaggtgacatgatttactattggatgtgggcatgagggaaggaaattaag
gatgactcctggatttttagcctgagcaactttatagctt >IGR2268a
gactgattagaaagcattgcagcattataggcaagagcttatgatggcctgaactagagt
ggtaactgtggaagagataaatggatgaattcagaatattttggaggaaaaaggtgaca
tgatttactattggatgtgggcatgagggaaggaaattaaggatgactcctggatttta
gcctgagcaactttatagcttttcatgttttgttttgaaatgggagatttgatgggtg
ggggtttgggaaattaagagttttttatttttattttttgctttttaaaaattgtggtga TABLE 5-continued aatacacataacataaaatttaccattttaaccactcttaagggcattaagtacattcac
attgtgcaaccatcaccatcatccatctgtagagaactcttttcatcttgcaaaattgaa
actctgtacctattaaacactaactccccactcccctccttaccctagcccgaaaaccc
ttctataatacagaagtctctatgaatttgaccactctcataagtggaatcacatagtat
ttgtccttttgtgactcgcttttattgtcacttagcataatgtcttcaaggttcatccat
gttgtagcatatgtcagaatttccttccttttttaagactgaataatatgccattatatat
gtatactacattttgtttaccattcatccactgatggac >IGR2269a
ctatgaatttgaccactctcataagtggaatcacatagtatttgtccttttgtgactcgc
ttttattgtcacttagcataatgtcttcaaggttcatccatgttgtagcatatgtcagaa
tttccttccttttttaagactgaataatatgccattatatatgtatactacattttgttta
cccattcatccactgatggacacttgggttgcttccatctttttgcctgttgtgactaatg
ctgctgtgaacatgtatgtacaagtatctatttgagtacttgcttttaattctttgggta
tatcccagaagtggaattgctggatcatgtggtaattctatgttttaattttttttaagga
attgccatactgttttccccggtagctgtaccattttacattcccaccaacagtgcacaa
gagttccagtttctccacgtcctcgccaatacttgttattttctgtggttttgctgttgt
tgttgttttgtttgttttttgttttttacagaagctatcctaatgggtataaagtggtat
ttcattgtggttttatttgcatttccctaattattaattatgttgagcatcttttcatgt
gcttattggcaatttatatattttctttggagaaatgtctactcaactcttttgcccatt
ttaaaatcaggttttttttttgttgttgttgaattgtagg >IGR2270a
gttttttttacagaagctatcctaatgggtataaagtggtatttcattgtggttttatttg
catttccctaattattaattatgttgagcatcttttcatgtgcttattggcaatttatat
attttctttggagaaatgtctactcaactcttttgcccattttaaaatcaggttttttttt
ttgttgttgttgaattgtaggagttctttacatatttgggatatgaaccacttatcagat
acatgatttgcaaatattttctcccattctatgccttttcactattgattatatcctttt
acgcacagaagttttacattttttgatgtagcccaattttttctattttttcttttgttgcc
tgtgcaagagttttattttaaatgcaattttgggatgtctattagacatccaagtcaaaa
tgtcaaatagacggctggatatatgagtctgaaggtcataaaagagatcagaatgagata
taaattagggaatcattcacatatagatggtatttaaggccatgggtctggacagaatca
cccaggagagaagtcataaggaacacataggtttccctagggaatacagtcatcttaga
gtaaaattccatcgaaggagatcaggaggtcttggctgagttaaatttggataatataag
ttattaactatgttaatgtgttctaagctagatgccaggt >IGR2271a
catatagatggtatttaaggccatgggtctggacagaatcacccaggagagaagtcatat
aggaacacataggtttccctagggaatacagtcatcttagagtaaaattccatcgaagga
gatcaggaggtcttggctgagttaaatttggataatataagttattaactatgttaatgt
gttctaagctagatgccaggttaaggcagaaattaggaggtcctgggcaagtatcaattt
gctctgctattgtattattacaagaataatactaacaatagtacatgacctcatttcatc
ctcacaatagctttacgcgattgatattcttgtcttcacttttacaggcaaagaaacaaaa
gagaagtaaagtaatttacccagttgctatagttagcatgtggtaggtccatattagagg
tctggtctgtctgcatgatggttaatttttatgagatagcaagtaaaacattatttgtgtc
tgtgtctgtgtctgtgaggatgtgttcggagaggttcacaagcatttgaatcagtagacg
gagcaaataaggtccgccctcaccaatgtgggcaggcatcatccaattcactgaggactc
ctgctcacacagaacaaaaagtcagaggatgtgcctatagttccagcttcttggaaggct
gcggcaggaagatgctgggcccaggagtttgaggccagc >IGR2272a
atgtgttcggagaggttcacaagcatttgaatcagtagacggagcaaataaggtccgccc
tcaccaatgtgggcaggcatcatccaattcactgaggactcctgctcacacagaacaaaa
agtcagaggatgtgcctatagttccagcttcttggaaggctgcggcaggaagatgctggg
cccaggagtttgaggccagcagggcaacatagtaagacctttctctttaaaaaaattt
tttttggctgggtgcagtggctcatgcctgtaatcccagcactttgggaggccgaggcag
gcggatcatgaggtcaggagatcgagaccatcctggctaacatggtgaaaccccgtctct
accaaaaatacaaaaaattagccgggcgttgtggtgggcacctgtagtacccgctactca
ggaggctgaggcaggagaatggagtgaaccccggaggcggaggttgcaatgagtggagat
tgcaccactgcactccagcctgggcgacagatcaagactccgtctcaaaaaaaaaaaaat
tttttttaaggcataggaagggcaaattctctcattctctctcttcttgagctgggaca
tccatttcctgccttcaggaaatcagagctccatgttcttggatctcccgactctgg
gacttacaccttacccttttcccctcagtctttcagactt >IGR2273a
ctgggcgacagatcaagactccgtctcaaaaaaaaaaaaatttttttttaaggcatagga
agggcaaattctctcattctctctcttcttgagctgggacatccatttctcctgccttc
aggaaatcagagctccatgttcttggatctcccgactctgggacttacaccttacccttt
tcccctcagtctttcagacttggactgaattacaccatcaccttttcctggttctccagct
tgcagatagcatgtcatgggacttcttagcctctgtaatcatatgagccagttcatatag
taaatctcctcctattgatctatacctatatctgtaatcctattagttgggtttctttgg
aaaactctaataccccttatccacagtttttttttttttctgcagtttcagttatctac
ggccaactgggtaaaccaaataggtgagtacagtacaataaaatattttgagagagagat
gcacatttgcatgacttctattacagcatattgttataatcattctatttttattagctat
tgttagtctcttattctgcataattttataaattaaattttatcttaggtacgtatgtatg
tatgtataggaaaaaacctagtatatatagtgttcagtactatctgaggtttcaggaatc
ccctggtgttcttggattgtagcccctgccttcaagcct TABLE 5-continued >IGR2274a
attacagcatattgttataatcattctattttattagctattgttagtctcttattctgc
ataatttataaattaaattttatcttaggtacgtatgtatgtatgtataggaaaaaacct
agtatatatagtgttcagtactatctgaggtttcaggaatcccctggtgttcttggattg
tagcccctgccttcaagcctgcactctcaattactgatgctacatctcattaccctgaa
agatgaaatctagccttgagcccttaccaactggctgcattagatcattttagatctcca
tgtcaccgcagtcacatttgtgtgtggtgaatggtccaggagagatggtgctattcctgc
caccttcattagcctggcttgcattctcttctgaacacttgggtcttattaacactgtgc
caggttctcatataccccaaataaagaaaaagaaagtagatggatacagtgtacatacta
ggcccaacagaagttatgcttttactccctttcctcttcaatttagatactactatggcc
ctttgcttccgtctatctcagttccttcgttgtcttatcattccattcacctctactgca
aggccctaaatccaaccatttggtcactgtactcctaccctgggtcactggaggaaatca
cacaaccatgtgagttggtgtcttgacacatttacatttc >IGR2275a
ttttactccctttcctcttcaatttagatactactatggcccttttgcttccgtctatctc
agttccttcgttgtcttatcattccattcacctctactgcaaggccctaaatccaaccat
ttggtcactgtactcctaccctgggtcactggaggaaatcacacaaccatgtgagttggt
gtcttgacacatttacatttccaatcacaattggaccctcagccacttgttactctctc
aacccatgtttccttgcacccatcaacagccccccttcttctctgtatcttaagtcagca
tcctggattgagagtgaagagtaaaatggtttgacttattgtgagcttagcctttgcaag
actagtaaacaaaaggactggggtagtggcaagagtatgaatgggctggagggatcacaa
ggtataaactgaaagggaaaggaaatgatatcaggtgagagctgaagagttgggaggaaa
acaaaggtcctagagtgagatggagctgttgtgactgatgagagagcccagggtgtgtcct
cagcagcaagagtgtgaagtataggtgaaggtcaagtactgcgaggctaaggtgtagcac
tactcatcttcctgagcacaaaagtcaccagcaccttgggctgggtgtcagagagctcac
agaatgtggataaccaaccaggcagatgttggtaacagca >IGR2276a
atggagctgttgtgactgatgagaggcccagggtgtgtcctcagcagcaagagtgtgaag
tataggtgaaggtcaagtactgcgaggctaaggtgtagcactactcatcttcctgagcac
aaaagtcaccagcaccttgggctgggtgtcagagagctcacagaatgtggataaccaacc
aggcagatgttggtaacagcaaccaggagggcacagcacaaacctgagcaggtctttat
gtatgtgaaggtgaaggagttatgatttagaaatggcagtgggaagcaaggagaatgctg
agagcctgctcagctcttgtcttccaggatcatggatagtgcaaaatgagtagccttcct
tgagagacagagccatgaggctagtggagtgctcagaaagaaccagatctctatcaag
gaaaggagatggagagaacaaccaggatgtacttgaaagaggagagttgcatgtctaca
atggaatatgttgcagaggactcagtcacagagaagacaactgcaggagggtgagctg
gagggctctgcaggggcaggagcacagtagggcattagaatgggagttttagatgagaag
gattacatttgcagtgctggaggaagatcatctcaaggttcacaaaatcaagcttttaaac
ttgtctgtgtcaacagacggaggcattgggtgatagttca >IGR2277a
ggactcagtcacagagaagacaactgcaggagggtgagctggagggctctgcaggggcag
gagcacagtagggcattagaatgggagttttagatgagaaggattacatttgcagtgctg
gaggaagatcatctcaaggttcacaaaatcaagctttaaacttgtctgtgtcaacagacg
gaggcattgggtgatagttcaaatccccataattttttataatccttcagcagtctgtt
aaatataaccttggtgataagctaagttacctcagcatagcaagcttggcttggtctaaa
tcagggtagaggtgattgctgctcaaaggaagtgagagagacacccagctctggattgga
gaacatgactttgacctgggtttcagcctccacagggctaagccccaggggagcactggg
caagttgctaaggccacaagcaggagtttataaccaggctagactaagcccactgatgca
agaatttttttttttttttttgagacagagtctcactctgtcacccgggctagagtgca
gtggtgtgatcttggctcactgcaacctccgcttccctgggttcaagtgattctcctgcct
cagcctctcaagtagctgggattacaggcacccgctaccatgcctggctaaattttgtat
ttttttagtagagacaggggtttcaccgtgttggccaggat >IGR2278a
tttgagacagagtctcactctgtcacccgggctagagtgcagtggtgtgatcttggctca
ctgcaacctccgcttccctggttcaagtgattctcctgcctcagcctctcaagtagctgg
gattacaggcacccgctaccatgcctggctaaattttgtatttttttagtagagacaggg
tttcaccgtgttggccaggatggtcttgagctcctgacctcaagtgatccacctgccttg
gcctcccaaagggctgggattactggcttgagccaccatgcccagcctgatgcatgaatt
tgcattcttcatgctcttcatctatgcttctgaaacctggcacttagtcaaacactcagt
aagttttatttttaactgctttatgattataaaagtaatatatgaagcatttgtaaag
tatggaaatctggaaaaaataaaacagaagtcatctataatctgaccatccaaacatacc
tactgttaataccttagtctacgttctttcttttttttccttttttttgagatggagtcttg
ctgtgttgcccaggctggagtacaatggcatgatttcggctcactgcaacctctgcctcc
caggttcaagcagttctcctgcctcagcctcccaagtagctgggcttacaggcatccacc
accatgcccggtaattttttgtattttttagtagagatggg >IGR2279a
tacgttctttctttttttcctttttttgagatggagtcttgctgtgttgcccaggctgga
gtacaatggcatgatttcggctcactgcaacctctgcctcccaggttcaagcagttctcc
tgcctcagcctcccaagtagctgggcttacaggcatccaccaccatgcccggtaatttt
tgtattttttagtagagatggggtttcgccatgttggccaggctggtctcaaactcctgac
ctcatgtgatctgcccgcctcagccttccaaagtgctaggattacaggtgtgagccaatg
cgcctggccttttttttttttttaagacagttttgctcttttttgcccaggctgtagtgcag
tggtgtgatcttggctcactgcaaccaggttcaagtgattttcctgcctcagccttctga TABLE 5-continued gtagctgggactacagacgccaccatgcccagctaatttttttgtatttttagtagagat
gggggtttcaccatattggccaggttggtctccaactctgactttgggtgatccgccca
cgttggcctcccaaagtgttgggattacaggcatgaaccactgtgcccagctgagcctac
tttcttctggtcttttctcatgcctcccaccaccaccccagcccccgccattacata
cgtatatatgtttattttttttaaagagatgaagtctt >IGR2280a
ccaggttggtctccaactctgactttgggtgatccgcccacgttggcctcccaaagtgt
tgggattacaggcatgaaccactgtgcccagctgagcctactttcttctggtcttttct
catgcctcccaccaccaccccagcccccgccattacatacgtatatatgtttatttt
tttttaaagagatgaagtcttgctctgttgcccaggctggtaggctgatctcaaactcct
ggcttcaggtgatcctcctgtgttggcctcccaaagtgctgttgttacaggcataagcca
tcacacctggctattttttcacgctttaaaaactcactttattcattcatttattcactca
ttctttgattaacactcatatactggttttatttattattttatattttagctacagg
gtctcactctgtgcccgaggctggagtgcagtggcatgatcatgactctgcaaccccgaa
ctcctgggctcaagggatcctcccaactcagcctcccaagaagttaggattacaggcaca
tgctaccacaccctgctaattttttttaaattaattttttcttccttttttttttttt
ttttttttgtagaaccagtgtgtgttaggccattcttgcattactataaagaaatacctga
gactgggtaatttattaagaaaagaggtttaattgactca >IGR2281a
ctcccaactcagcctcccaagaagttaggattacaggcacatgctaccacaccctgctaa
tttttttaaattaattttttcttccttttttttttttttttttttttgtagaaccagtg
tgtgttaggccattcttgcattactataaagaaatacctgagactgggtaatttattaag
aaaagagtttaattgactcacgatttcacaggctgtataggaagtgtggcactaggcat
ctgctcagcttctagggaggcctcagggagcttttactcacagtggaaggtgaaggggga
gcaggtgtgtcacatggtaaagacaggagcaaggtgggggaggtgccacacccttaaac
aaccagatttctcaagaactcacttattatggtggggacagctccaagccatgagggatc
tgcccccatgaccaaaacacctcccagcaggccccacctccaacattagagattacattt
ccacatgcgatttggacagggataaatatccagactatgtcattttgcccctggccctcc
taaatctcatgtccttctcaagttgcaaaatacaatcatgccttcccaagagttccccaa
agtcttaactcattccaatgttaactccaaagcccaaaattcaaagtctcatctgagaca
aggcaagtctcttccacctatgagcctataaaatcaaaaa >IGR2282a
ggataaatatccagactatgtcattttgcccctggccctcctaaatctcatgtccttctc
aagttgcaaaatacaatcatgccttcccaagagttccccaaagtcttaactcattccaat
gttaactccaaagcccaaaattcaaagtctcatctgagacaaggcaagtctcttccacct
atgagcctataaaatcaaaaacaagctatatacttccaagttacaatgggtgtataggca
ttgggtaaacatgcccattccaaaagagaaattggccaaaagaaaggggctacaagctcc
atgcaaattcaaaacccagcagggcaattattaaattgtaaagctccaaagtaatcttct
ttgactccgtgtcccatatccagggctcactggtgcaagaagtgggctcgcaaggccttg
ggaagcttcgcccctgtagtttgcatagtacagcctccacagctgctcttatgggctaga
gttgagtgcctgtgcttttccaggcacagggtgcaagctgccagtggatctaccattct
caggtctggagggtggtgaccccttctcacagctccaccaggcagttcccagtggaga
ctgtgtgggccttcaaccccacatttcccctccaaactgccctagtaggggttctctgt
gagggttccacccctacagcaggcttctgcctgggtaccc >IGR2283a
tccaggcacagggtgcaagctgccagtggatctaccattctcaggtctggagggtggtga
ccccttctcacagctccaccaggcagttcccagtggagactgtgtgggccttcaacc
ccacatttcccctccaaactgccctagtaggggttctctgtgagggttccacccctacag
caggcttctgcctgggtaccctggcttcttgtacatcctctgaaatctaggtagaggct
gccaagcctccttcactcttacagtctgcatgcctgcatgcttaacaccacatggaagct
gccaaagcatatggcttttgctctttggagcagcagcctgagctgtacctgaggcccctt
gagccacagctggagctggaacagcctggatgtagggagcactgtcctaaggaggctgtg
cagagccatgggtcctaggcctagcccatgaaatgattcttcctcctaggtctctgggc
ctgtgcctgtgatggcaagggctgccctgagatctctgaaatgccttcaaggccttttt
cccattgtcttagctattagtacctggctctcttttagttattcaaatttctctagcaag
tggttgctccacagcctgcttgaattcctctactgaaaatgcttctgctttctctatcac
atggccaggctgcaaattttctaaagttttacactctgct >IGR2284a
ggctgcccctgagatctctgaaatgccttcaaggcctttttcccattgtcttagctatta
gtacctggctctcttttagttattcaaatttctctagcaagtggttgctccacagcctgc
ttgaattcctctactgaaaatgcttctgctttctctatcacatggccaggctgcaaattt
tctaaagttttacactctgcttcccctttaaatataacttctaactttaagtcattttt
ttgctctcacatctgagttaagctgttagatgcagccatgtaacttcttgaacactttgc
tgcttagaaatttcctctgccagatacccctagttgtcactctgaagttcaaacttccaca
gatccttacagcatgaacaaagtgcagccaagttctttgctaggccataatgagggtggc
ctttgctccattctaggttcctcatttccatctgagacctcatcagccacgccttcact
ttccatatcaccatcagcattctggttacaaccatttgaccagccaagtactattctaac
ttctgagaatacagaagtgctcctcatggaacttacagtctagtggaggaagaaggacaa
taaatgcaacaaagaagtaaattagtcaggatgtcagagagtgataagtcccatggagaa
aaatgaagcaggagaaaatgaagcagggatgcataaagt >IGR2285a
ttctggttacaaccatttgaccagccaagtactattctaacttctgagaatacagaagtg
ctcctcatggaacttacagtctagtggaggaagaaggacaataaatgcaacaaagaagta TABLE 5-continued aattagtcaggatgtcagagagtgataagtcccatggagaaaatgaagcaggagaaaaa
tgaagcaggatgcataaagttagttcagagagagaacaggatacaattttaaatagtgt
ggtcagataaggggtttattaaggaggtggcatttgggccaagacactaaggaagtaagag
aacaagctatgtagatagctgggaagacattcctaggaagagggaacaagtatctaata
gagaagcatgtctagtatgttcaaagaatagcaaagccttggtagccttaatgaagaaag
caatggagagagtaataagagatgatgtcagcgagctaaaggagggcatgaagattagag
tagggccctataaactggatgaccactgtcaaatgaaattaaggctgttgaggcagaaat
gatttgataaaagtttattggaagccaaatgtgaggatgaacccaggaaaacacaccaac
aaagttgagagtgttctggagtctgttacaagttggaaagttagaagacaggaggggggac
tcttcatacaggagttgtccttttcactggagggtacaa >IGR2286a
tgaccactgtcaaatgaaattaaggctgttgaggcagaaatgatttgataaaagtttatt
ggaagccaaatgtgaggatgaacccaggaaaacacaccaacaaagttgagagtgttctgg
agtctgttacaagttggaaagttagaagacaggagggggactcttcatacaggagttgtc
cttttcactggagggtacaatacaaaggttacaataattggctacagattgcaacatgc
agactaacatgtctacatgcaagacaatcagtaaatgttatgactcagaaataaatcag
tgtccttttcagtgtcagtaggtggtgcattgatcagtacatcaacaatttgaggaactt
ctaagattccttactcaggacaaggtatcgccatgaatcacaagaccttcccaagatggg
ttaatttggaagctgtttacttttaaagtaaactgtcaaatgtgacctgtaggttattgc
catatataatttgtcatccaaattaggagacttctagaatgaaagttggaggtgagggtt
attaatcattaacactagggctggttgccgtggctcacgcttgtaatcccagtactttgg
gaggctgaggcaggcagatcacgaggtcagggattgagaccatcctggccaacatggtg
aaaccccgttctctactaaaaaatacaaaaaaaaaaaaa >IGR2287a
aaattaggagacttctagaatgaaagttggaggtgagggttattaatcattaacactagg
gctggttgccgtggctcacgcttgtaatcccagtactttgggaggctgaggcaggcagat
cacgaggtcagggattgagaccatcctggccaacatggtgaaaccccgttctctactaa
aaaatacaaaaaaaaaaaatttagctgggcatggtggcacatgcctgtaatcccagct
actcagaaggctgaggcaggagaattgcttgaaccagggagtcggaggttgcagtgagct
gagatcatgccactgcactccagcctggcaacagagcgagactccgtctcaaaaaaaaaa
aaaaaaaagttaacactagttcagtggagagaagccaggactgtgctggacaaactgt
acgtgtaatcattctacttatagaccattgtaaggacttgggctttcaaaaaatctgact
gagatgggaagcgattggaaggttttgagcagaaaagtaacatgatgtgattgagatatc
cctgactactatgctgagagtagattgaaggggcgtaggagcagccttaatgaagaagga
ttggctgggggctaacagaatgcagggaagaaactggattctgcatatgttgaaattatg
gcaaaagattttattgacagattggatgtggagtacaaga >IGR2288a
aggttttgagcagaaaagtaacatgatgtgattgagatatccctgactactatgctgaga
gtagattgaaggggcgtaggagcagccttaatgaagaaggattggctgggggctaacaga
atgcagggaagaaactggattctgcatatgttgaaattatggcaaaagattttattgaca
gattggatgtggagtacaagaggaagagcagccaggaaataaagtttccatttactgag
ttggggaggacttcaggaagagcagatttgggatgaaattaggagcacatgttaaatttg
acatgttatgtttgagacacctattatatatccaagtgaggatatcaagtgggcagttat
tatgtgagcctggagttcactctctctatgtgttggtggtcatcagtgcagagatgatat
ttaaatcatgagactggattttttaaaaaggaagaggactgaagactaagttctgggcac
tccaattttgggcagtagcggagatgaagaaaaaccagcacactagatggtaaaggagca
gccaacaaggtaagaggaaaaccaagcaagtgtcattttttgttgattttttttgatacaga
gtctcactctgtcactcaggctggagtgcaatgacacaatctcggctcactataacctct
gccttctgggtccaagtgttttcttgcctcagcttccca >IGR2289a
ggagatgaagaaaaaccagcacactagatggtaaaggagcagccaacaaggtaagaggaa
aaccaagcaagtgtcattttttgttgattttttttgatacagagtctcactctgtcactcag
gctggagtgcaatgacacaatctcggctcactataacctctgccttctgggtccaagtgt
ttttcttgcctcagcttcccaagtagctgggactgcaggtgtgtgccaccacgcctggcg
caagtgtcatgtagaaagcagttcaaggatgaaagagaaatgagtttgtcaaatgccttg
agaggtcaggtaagatgatgactgtgaattgactattgaattcagaaacatgcaggtcac
tgcggaccttgatagagtgctctggtgaaaggtgagggctaaagcttaattgtagtggg
gccaagtgaaaattggaagaacaaagttgaaagtagcaagtagatatagcaatcttccaa
ggagtttcactgctaagggacaggagaaatggggcaggagctgacagcagaaactgggt
caagagagagcttttacagcctctttgcatactgaatgggaaagatccagtagagaggga
aaagatttatgatgggggagtcaggagaattgctagagcaacatgtgctcctaatttcat
cccaaatctgctcttcctgaagtcctccccaactcagtaa >IGR2290a
acagggagaaatggggcaggagctgacagcagaaactgggtcaagagagagcttttacag
cctctttgcatactgaatgggaaagatccagtagagagggaaaagatttatgatgggggga
gtcaggagaattgctagagcaacatgtgctcctaatttcatcccaaatctgctcttcctg
aagtcctccccaactcagtaaatgaaactttattttcctggctgctcttcctctcgtac
tccacatccaatctgtcaataaagtcttttgccataatttcaacatatgtagaatccagt
ttcttgcctgtattctgttagcccccagccaatccttcttcattaaggctgctcctacgc
cccttcaatctactctcagcatagtagtcagggctatctcaattacatcatgttactttt
ctgctgttggtaagggagtaggggtggggagggtaagaagtatataaggctgggcc
gggcacagtggctcacacctataatcccagcactttgggaggctgaggcaggccaatcac TABLE 5-continued ttgagcccaggagttcagtactagcctagccaacatggcaaaaccctgtctctactaaaa
atacaaaaattagctgggtatggtggtgcatgcctgtaatcctagctacttcggaggctg
aggcatgagaatcgtttgaacctgggaggcagaggttgca >IGR2291a
tataatcccagcactttgggaggctgaggcaggccaatcacttgagcccaggagttcagt
actagcctagccaacatggcaaaaccctgtctctactaaaaatacaaaaattagctgggt
atggtggtgcatgcctgtaatcctagctacttcggaggctgaggcatgagaatcgtttga
acctgggaggcagaggttgcagtgagccactgcactccagcggggaggagagaccattca
ggagaaacgggagaaaagacagagggtgtgggtacagatggagttaggctggtggattat
gctgcttgtagaggttctctccattgcttctattttctaggtgaaataggaagccaaggc
acagctgagggtgatcatgggggaggaggtgatggagttctgaagagaaagaaggtcttc
caggatagagaatgaaccaggggcaattaggatcctcttgaagtcactgatggtcagttta
aagtgaaaccagtcagatggaatatattttccatctacatttggctatgcaggtgctagc
aagaagtaggagggaggttagatttaaccagctttatagtttcccacaaaagcaaggcag
ataagaaaggggcaaggaagatgattatgatgattaagcatggaatttaagctggccaag
aagggtgtgaggacatgagtaagatgagagatagcaaaa >IGR2292a
gaatatattttccatctacatttggctatgcaggtgctagcaagaagtaggagggaggtt
agatttaaccagctttatagtttcccacaaaagcaaggcagataagaaaggggcaaggaa
gatgattatgatgattaagcatggaatttaagctggccaagaaggggtgtgaggacatga
gtaagatgagagatagcaaaaacgtggacatctttgccaggtatggagccaaacacagta
tgcattgtctcatgtaatcccacccaaatggaattgttatcatccctctttacagatga
agaagctgagttttagggaagactgtaacttgctcaaagtcacacagctgatagagaagt
gacacacccagcatcaggtcctggaacacttgtctccaaaggctatgtacttagccctat
ttgcttaactggagtattagtgggcattacaaaaattgatgcatatgtacaaaggatgg
taattttgtccagtatgttttgttaatacttttccaacttgagttaattttaagatttt
ctgttgtacagaattctttaaaagtttatagtaaaatctatttatcttcaatttcctatt
catcttaaaattaaatgtcacctatattttcttctagcttttgatttatttactcttggc
tctattttatttacatttattacatttggctctttagttg >IGR2293a
tttgttaatacttttccaacttgagttaattttaagattttctgttgtacagaattcttt
aaaagtttatagtaaaatctatttatcttcaatttcctattcatcttaaaattaaatgtc
acctatattttcttctagcttttgatttatttactcttggctctattttatttacattta
ttacatttggctctttagttgatcaggaattaatttggtatgtggtttatggtgggatac
tatttattccccagttttttccatttttaccagttcttcagcttgtcgattgtcccagca
ccagtcttcaacaatgtatcatttttcttgataatttataattcatctttatcatatgtta
caattttttcaacacttgggtctgtttctgtgatacctcttctatttcgttgattgattta
tcttttgtgtgtgtctgtgtgtgtgtgtgtgttttgtgtgttttttccaggaaacccag
agtagtgtagtcattgtgtgttttttatatatgtaagagaacatttccccttatcaatgat
cttttttcaaaaatttcttaaacatattacatatttctttttttcagatgctctttacaaat
attttttaacttcttaaaatatctcattgaggattccgttccaagatggccaaataggaa
cagctctggtctgcagctcccagtgtgatcgacgcagaag >IGR2294a
gtttttatatatgtaagagaacatttccccttatcaatgatcttttttcaaaaatttctta
aacatattacatatttctttttttcagatgctctttacaaatattttttaacttcttaaaa
tatctcattgaggattccgttccaagatggccaaataggaacagctctggtctgcagctc
ccagtgtgatcgacgcagaagacggatgatttctgcatttccaactgaggtacctggttc
atcttactaggactggttggacagtgggtgcagcccacggagggtgagccgaagcagggc
agggcatcgcctcacctgggaagcgcaaggagtcaggggatttccttttcctagccaagg
gaagccgtgacagatggtacctggaaaaacgggacactcctgcccaaatactgcgcttt
ccaaagtcttagcaaatggcacaccaggagattatatcctgtgcctggctcgacagatcc
tatgtccatggagccttgctcactgctagtgcaacagtctgagattgacctgcaaggcag
caacctggcatggggagggcatccgccattgctgaggcttgagtaggtaaataaagtgg
ctgtggaagctcgaactgggtggagcccaccacagctcagcaaggctgactgcctctgta
gtctccacctctggggcagggcatagctgaacaaaaagca >IGR2295a
tcactgctagtgcaacagtctgagattgacctgcaaggcagcaacctggcatgggaggg
gcatccgccattgctgaggcttgagtaggtaaataaagtggctgtggaagctcgaactgg
gtggagcccaccacagctcagcaaggctgactgcctctgtagtctccacctctggggcag
ggcatagctgaacaaaaagcagcagaaacttctgcagacttaaacatccctgtctgacag
ctctgaagagagcagtggttctcccaggatggtgttttagcttggagaacagacagactg
cctcctcaagtgggtccctgacccccatgtagcctaactgggagacacctcccagtagcc
gactgacacctcatacaggcaggtgccctctgggatgaagcttccagaggaaggatcac
tcagcaatatttgctgttctgcaatatttgctgttctgcagcctctgatggtgatacca
ggcaaacaggtctggagtagacctccagcaaactccaacagacctgcagctgagggacct
cactggtagaaggaaaactaacaaacagaaagaaatagcatcaacatcaacaaaaaggac
atccacaccaaaacccatctgtaagttaccaacatcaaagaccaaaggtagataaaacc
acaaagatggggagaaaccagagcagaaaagctgaaaatt >IGR2296a
gacctccagcaaactccaacagacctgcagctgagggacctcactggtagaaggaaaact
aacaaacagaaagaaatagcatcaacatcaacaaaaaggacatccacaccaaaaccccat
ctgtaagttaccaacatcaaagaccaaaggtagataaaaccacaaagatggggagaaacc
agagcagaaaagctgaaaattctaaaaaccagagcacctcttctcctccaaaggatcaca TABLE 5-continued actccttgccagcaatggaacaaagctgggtggagaatgactttgacgagctgacagaag
tggacttcagaaggtcagtaataataaacttctcccagctaaaggaggatgttctaaccc
atcgcaaggaagctaaaaaccttgaaaatagattagacgaatggctaactagaataaaca
gtgtagagaagaccttaaatgacctgatggagctgaaaaccatggcacgagaactttgtg
acacatgcacaagcttcaatagccgattcgatcaagaaaggatatcagtgattgaagatc
aaattaatgaaataactcaagaagattagagaaaaaagagtaaaagggaacgaacaaagc
ctccaagaaatatgggactatgtgaaagaccaaatctacgtttgattggtgtacctgaaa
atgacagggagaatggaaccaagttggaaaacactcctca >IGR2297a
tagccgattcgatcaagaaaggatatcagtgattgaagatcaaattaatgaaataactca
agaagattagagaaaaagagtaaaagggaacgaacaaagcctccaagaaatatgggact
atgtgaaagaccaaatctacgtttgattggtgtacctgaaaatgacagggagaatggaac
caagttggaaaacactcctcaggatattatcaaggagaacttccccaacttagcaaagca
ggccaacattcaaattcaggatatacagagaatgccacaaagatactcctcaagaagagc
aaacccaagacacataattggcagattccaccaaggttgaaatgaaggaaaaaatgttaag
cgcagccagagagaaaggtcgggttacgcacaaagggaagcccatcagactaacagcgga
tctctcggcagaaaccctacaagcccgaagagagtgggggccaatattcaacattcttaa
agaaaagaattttcaacccagaatttcatatccagccaaactaagcttcataagtgaaga
ataaaatcctttccagacaagcaaatgctgagagattttgtcaccaccaggcctgcccta
aaagagctcctgaaggaagcactaaacatggaaaggaaaaaccggtaccagccactgcaa
aaatatgccaaattgtaaagaccatcgatgctatgaagaa >IGR2298a
agaatttcatatccagccaaactaagcttcataagtgaagaataaaatcctttccagaca
agcaaatgctgagagattttgtcaccaccaggcctgccctaaaagagctcctgaaggaag
cactaaacatggaaaggaaaaaccggtaccagccactgcaaaaatatgccaaattgtaaa
gaccatcgatgctatgaagaaactgcatgaactaacaagcaaaataaccagctaacatca
taatgacaggatcaaattcacacataacaatattaaccttaaatgtaaatgggctaaatg
ccccaattaaaagacacagactggcaaattggataaagagtcaagacccatccgtgtcct
gtattcaggagacccatctcacgtgcagagacacacataggctcaaaataaagggatgga
ggaagatctaccaagcaaatggaaagcagaaaaaagcaggggttgcaatcctagtctctg
attaaacagactttaaaccaacaaagatcaaacgggacaaagaaggccattacataatgg
taaagggatcaattcaacaagaagagctaactatcctaaatatatatgcacccaatacag
gaacacccagattcataaaacaagtccttagagacctacaaagaaacttagactcccaca
caataataatgggagactttaacaccccactgtcaatatt >IGR2299a
aacaaagatcaaacgggacaaagaaggccattacataatggtaaagggatcaattcaaca
agaagagctaactatcctaaatatatatgcacccaatacaggaacacccagattcataaa
acaagtccttagagacctacaaagaaacttagactcccacacaataataatgggagactt
taacaccccactgtcaatattagacagatcaatgagacagaaggttaacaaggatatcca
ggacttgaactcagatctgcaccaagcagacttaatagacatctacagacctctccaccc
caaatgaacagagtatacattcttctcagcaccacatcacacttattccaaaattgacca
catagttggaagtaaagcactccttagcacatgtaaaggaacagaaatcacaacaaactg
tgtctcagaccacagtgcaatcaaattagaactcaggattaagaaactcactcaaaactg
cacaactgcatggaaactgaacaatctgctcctgaatgactactgggtaaataacgaaat
gaaggcagaaataaagacgttctttgaaaacaatgagagcaaagacacaacgtgccagaa
tctctggaacacacttaaagcacggtatataggggaaatttatagcactaaatacccacaa
gagaaagcaggaaagatcaaatcaacaccctaacatcat >IGR2300a
aacaatctgctcctgaatgactactgggtaaataacgaaatgaaggcagaaataaagacg
ttctttgaaaacaatgagagcaaagacacaacgtgccagaatctctggaacacacttaaa
gcacggtatataggggaaatttatagcactaaatacccacaagagaaagcaggaaagatca
aaatcaacaccctaacatcataattaaaagaactagagaagcaagagcaaacaaattcaa
aagctagcagaaggcaagaaataactaagatcagagcagaactgaaagagatagagacac
aaaaacttcaaaaaaatcaacgaatccaggagctcgttttttgaaaagatcaacaaaatt
gatagactgttagcaagactaataaagaagaaaagagagaagaatcaaatcgatggtata
aaaagtgataaaggggatgtcaccaccaatcccacagaaatacaaactaccatcagagaa
tactataaacacctctacacaaataaactagaaaatctagaagaaatggatacaattcctg
gacacatacagcctcccaagactaaaccaggaagaagttgaatctctgattagaccaata
acaggctctgaaattgaggcagtagttaatagcccaccaaccaaaaacagtccaggacca
gacagattcacagccaaattctaccagaggtacagaggag >IGR2301a
caaataaaactagaaaatctagaagaaatggataaattcctggacacatacagcctcccaa
gactaaaccaggaagaagttgaatctctgattagaccaataacaggctctgaaattgagg
cagtagttaatagcccaccaaccaaaaacagtccaggaccagacagattcacagccaaat
tctaccagaggtacagaggagctggtaccattctttctgaaactattcctagcaatagaa
aagagggaatcctccctaattcattttatgaggccagcatcatcctgatacccaaagcctg
gcagagacacaacaaaaaaaagagaggccgggcgcggtggctcacgcctgtaatcccagc
actttgggaggccgaggcgggtggatcatgaggtcaggagatcgagaccatcctggctaa
caaggtgaaaccccgtctctactaaaaatacaaaaaattagccgggcgcggtggcgggc
gcctgtagtcccagctactcgggaggctgaggcaggagaatggcgtgaacccgggaagca
gagcttgcagtgagccgagattgcgccactgcagtccgcagtccggcctgggcgacagag
cgagactccgtctcaaaaaaaaaaaaaaagagaattttataccaatatccctgatgaa
catcgatgcaaaaatcctcaataaaatactggcaaaccga TABLE 5-continued >IGR2302a
cgggaggctgaggcaggagaatggcgtgaacccgggaagcagagcttgcagtgagccgag
attgcgccactgcagtccgcagtccggcctgggcgacagagcgagactccgtctcaaaaa
aaaaaaaaaagagaattttataccaatatccctgatgaacatcgatgcaaaaatcctc
aataaaatactggcaaaccgaatccagtagcacatcaaaaagcttctccaccacgatcaa
gtgggcttcatccctgggatgcaaggctgtttcaacatatgcaaatcaataaacataatc
catcacagaaacagaaccaatgacaaaaaccgcttgattatctcaatagatgcagaaaag
gccgtcgacaaaattcaaaagcccttcatgctaaaaactctcaataaactaggtattgat
agaacgtttctcaaaataataagagctatatatgacaaacccacagccaatatcatgtgg
aatgggctaaagctgttgacctgatagatatggttcaagaggacacagctgaatactgt
gcttaggaaaagaacagtttcaaaggctttccagattgtcagatttgatgatatcctcct
tggtgcacacctctcttggctatggggcacataaaccacctctaccaatctaactggttt
gtgcagttttctgattttgtatctaccggcaaaatatat >IGR2303a
cctgatagatatgggttcaagaggacacagctgaatactgtgcttaggaaaagaacagtt
tcaaaggctttccagattgtcagatttgatgatatcctccttggtgcacacctctcttgg
ctatggggcacataaaccacctctaccaatctaactggtttgtgcagttttctgatttt
gtatctaccggcaaaatatatcttaagccattttaggaaacaggaggtttagtcacgtg
ctcaacaaaagcacaacaaatggggagcatttaatggtgtaagggctgtgaggtgtagct
gctgaaactgtagctaggagctgccttgctgccttcttgcaggcagattggccagatgag
ccaggctaaaatacaattaatatctaccattgtggtttaatatgaaatatggatacctgg
tctttgtctcagttcttgtcatagagttccccaaacctttagaacttcctgagtggtagg
aatatctcattagtgataatgagccccttttgattcgataactcctgagtttatgctaatg
aggttacttaatgtggggccctagatattcttaggatgggctagttcccggaaagacca
ggtcatttgaggattagaggggttggaacttttagctctacccactgatctctgggtgggg
aaggtgctggagatcaagctgcctaaaaactcttgaacaa >IGR2304a
tgagccccttttgattcgataactcctgagtttatgctaatgaggttacttaatgtggggc
cctagatattcttaggatgggctagttcccggaaagaccaggtcatttgaggattagag
ggttggaacttttagctctacccactgatctctgggtggggaaggtgctggagatcaagc
tgcctaaaaactcttgaacaacaagatttgaggagcttccagtaaatgcgtccacaagct
gggagggcactgcaccccagtttcactgggacagaagctcttgcacttggaatctttcca
gacctagccccttcatgctgcttcatctggctgttcatctgtatcctttataataaattgg
caaatgtaaaggtttagctgaatttggtgagcctttctagaaaattaattgaacctaaga
aggggtctgtggaaaccctggtttgtagttggtaggtcagaggtgcgtggcttggatg
ttcgaatggcatctgaagagggacagagcacacaacctgtgggatctgacactatctccc
cgcagatagggtcagagcttaattctattagagaacaccccattggtatctgctggagaa
ttacttggtgtatgagaagcccccaccacatctggtcacagaagtattgtgggttgagt
gtgacagtacagggtaaaaagtggtttgttttttcctcta >IGR2305a
gggacagagcacacaacctgtgggatctgacactatctccccgcagatagggtcagagct
taattctattagagaacaccccattggtatctgctggagaattacttggtgtatgagaag
cccccaccacatctggtcacagaagtattgtgggttgagtgtgacagtacagggtaaaa
agtggtttgttttttcctctaacagtgatcactccctctcaaaggagtgtggaaggtttt
ctggataggaatactgcatataatcatttggttcacttcagaaactactataattttgac
tgtgctggttcacttccacatgtacaaacacacacacatacacacacattgttgtcacct
aatatttgcgttaatacaatgatgttatttttatttggatagtatttgtatgattggaaa
tgagtgttaatcttatatgtatttttaccagtccttgactaacatgttttcaagacatct
taccaatccatttcattgaattaatgagtaaggagactctctagaaatggttggtttgta
aagcaaggacattatctggaagaatcatccagagtttactgtatgacgagcatttcttga
tagcaaggttcattttggtgtcaatcgttacagtcagtccatttcagtgggaacaacgaa
tttctccacagggtcttattttctgttttcacttcacc >IGR2306a
attaatgagtaaggagactctctagaaatggttggtttgtaaagcaaggacattatctgg
aagaatcatccagagtttactgtatgacgagcatttcttgatagcaaggttcatttggt
gtcaatcgttacagtcagtccatttcagtgggaacaacgaatttctccacagggtcttat
ttttctgttttcacttcaccaaatggggtagatatttttcagaatgcagttattagaa
ccttgggattttcttctgtctccattgagtctcttgttttttcccagatctgaacctga
aaataaaaatagatgctaaggaaaattaaatattcaagactttcctcctcaaaatgctcca
tccaaattgacattgaaaaatatttctccaatcaatgaacaagtaactatttgaactcta
atgagaacctcatggtgtagatctaatattttatgcttttaaacatctgaggctactttc
ttaattaagcatagaagccagaatttaaactcttttcacagttttcccaagcaaaggatag
agagggaggcatgaaattcttggcaattaaagttgatactgaagtagttctatcattaga
agaaaacaacttatcaacaatgggcacttttttgctataaatgttctgtcagggatcagaa
ttaattcatatgcagagttacctttatcaaggccaggcac >IGR2307a
agaatttaaactctttcacagttttcccaagcaaaggatagagagggaggcatgaaattc
ttggcaattaaagttgatactgaagtagttctatcattagaagaaaacaacttatcaaca
atgggcacttttttgctataaatgttctgtcagggatcagaattaattcatatgcagagtt
acctttatcaaggccaggcacctgggaacactttatctttttataacctcaaaatagccgta
tgaaatatcccatatagcagatgggaatactgaagcttagtgaatattaagtgatatgcc
caaattttttgcagtagatttgggatttaaagccaggcagtgttactgaaactctaaact
tctcctaaataccactaatcttttaaatgtttgctgtggtgtcataaaaagatactggtc
tttgtccctggctcctaacatagagatcctaaatctcttataatttctggagtgataggg TABLE 5-continued agtgataaaagcttcttttgttctaatgaggcaacccttggctgggcccttagatagctt
cagggtgggggctggtcaccagaagactaagcctggattagaagcctggaacctctgggg
agaggagagaggctggggatagacttaataatccatcatgccaacatgactaaacctcca
tgaaaacctctaaatgatgggtttggagaacttccgagt >IGR2308a
gttctaatgaggcaacccttggctgggcccttagatagcttcagggtgggggctggtcac
cagaagactaagcctggattagaagcctggaacctctggggagaggagaggctgggga
tagacttaataatccatcatgccaacatgactaaacctccatgaaaacctctaaatgatg
gggtttggagaacttccgagttggtgaccacatccacatgccaggagggcagtgcacctt
aactccgtagggacagaacctctgcactcaggacccttccagacctctctgtatgtacct
cttcatctggctgttcatttgtatcctttgtaagaaaccgctagtggccagtgttctgag
tgctgtgagtcattctagcaaataatcaaacccaaggagggggatttgttggaacccaga
cttggtagcaaagtcagagagaaatgtgggtaacctggggacctgacatttgtgagtggc
aagtgaagcaaggcagtattgtgggactgagtcttacacctgtggagtctgatgctaaa
tttaggtattgtcaaaattgaactgcattataggacactcaataggtgtcagaattggtt
tgcgtcaagaagaaaaaccccttgcgcaatctcataagccaaaaaaagatgttgaattgtt
ttattttttgcatttccttattaatgtggacaaataactttt >IGR2309a
tgtgggactgagtctttacacctgtggagtctgatgctaaatttaggtattgtcaaaatt
gaactgcattataggacactcaataggtgtcagaattggtttgcgtcaagaagaaaaacc
cttgcgcaatctcataagccaaaaaaagatgttgaattgttttattttttgcatttcctta
ttaatgtggacaaataactttttcatgtatatattggacactgaagtgacttcttctgt
aaactgtctgttcttgtcctttgctggttttcctactgaattgttttgtcttttctcact
ggttactatgagctttttgtatattaagtatattagccttatgtttaggttttgtgtagc
aaatattttctcctggcttattgacttttgtctttgtgggtggtttcttttttgccttgcc
aataatttaaaaaatgtacaatcagatatatcaatctgttcctttatggttctttgattt
tatgttatgctcagtaagatcttctctaaggttataaaaatgtttgtttcctcctggtat
atttatgattttacatttttaggcctaaattttttaactgtctggatttttatcttgatgt
gttttttttttggagacggagtctcgctctgtcacgcagactggagtgtagtggcgcgat
ttcggctcactgcaacatccaccaccctggttcaagcgat >IGR2310a
tcttctctaaggttataaaaatgtttgtttcctcctggtatatttatgattttacatttt
taggcctaaattttttaactgtctggatttttatcttgatgtgttttttttttggagacgg
agtctcgctctgtcacgcagactggagtgtagtggcgcgatttcggctcactgcaacatc
caccaccctggttcaagcgattctcctgcctcagcctcccgcgagctgggattacagggg
tgcgccaccatgcctggctaattttttgtatttttagtagagatggggtttcaccatgttg
gacagactgttctcgaactcctgacctcaagcaatctgcctgcctcaatctccctaagtg
ctgggattacaggtgtgagccaccatgcccagcaatgcatttttttaaagagacaactt
ttaatttattcaaaatgtctagctgaatgttctaatacctttttactgaataactattccc
ccttgactttgctacttttttattacatactgaattttttatattttcttgggttttatcct
gaactctatcctattccattggtttctattcctataccattatcacattgtttttaattac
tattgctcaacaatatgctttattactattattattattttttgagacagagtctagctct
gttgcccagtctggagtgcggtggcatgatgttggctcac >IGR2311a
tattacatactgaattttttatattttcttgggttttatcctgaactctatcctattccat
tggtttctattcctataccattatcacattgttttaattactattgctcaacaatatgct
ttattactattattattattttttgagacagagtctagctctgttgcccagtctggagtgc
ggtggcatgatgttggctcactgcaacctccacctcccgggttcaagcaattctcctacc
tcagcctcctgagtagctgggactacaggtgtgtgccaccatgcccagctaattttttgta
tttttagtagagacagggttttcaccatgttggccaggatggtctcgatctcttgacctca
tgatccgcctgcctcagcctcccaaagtgttgggattacaggcatgtgccaccgcgcctg
gcctattatttatttatttttttgagacggagttttgctcttgttgcccaggctggagt
gcagtggtgtgatctcagctcactgcaacctctgcctcctgggtcaagcagttctcctgc
ctcagcctcctgagtagctgggattacatgtgactgccaccacacccagctaattttttg
tattttttagtaaagatgaggtttcacta >IGR1000a
ggctctgactaaagaatatgacagatcagatattcctctccacctgctcccctcccccat
cccttttttagagggctggggaaattttagttttttaatcaaaggctttatttctccagttg
tgcaaaggaatttaactgggactttacaactgaataaagtatttctcagagtcgatacta
atcttagcaagaggatattgcctaacccaacctaaaagcagcagagtcattacagaaata
ttatgttggccttgatttctaccccaccatgagttatgctactcaccaggtagcctgttt
tgttttttcattttagagacagggtctcactctgtcacccaggttggagtgcagtgtcac
aatcatagcttactatgacctcaaactcttaggctcaaatgatccacctcagcctcccaa
gtagctgggaccacaggtgtctgccactacacttggctaattttttaattttttgtagag
ataggagcttgctaagttgcccaggttggtttggaactcctggcttcaagcagtcctccc
gccttgggctccccaaagtgctgaggttacaggcgtgagccactgttgcccagcatgtgccc
tgttttaagtgtatctcctgctgtagtccgttacatgtgcacatctcttctgtgtttact
gtgtacctgctctatgctgagaagaatgtcttttcaaaac >IGR1001a
cccaggttggtttggaactcctggcttcaagcagtcctcccgccttgggctcccaaagtg
ctgaggttacaggcgtgagccactgtgcccagcatgtgccctgttttaagtgtatctcct
gctgtagtccgttacatgtgcacatctcttctgtgtttactgtgtacctgctctatgctg
agaagaatgtcttttcaaaactcacaccctcccttaggagagagaggtggccacatgaat TABLE 5-continued ggagaatgactgcatagcatgctgagggctgtggtaaaagaggctgaatggtgagctgcc
aggtacggcatccttcctgtgcagctgacatggtgcctgacacatgtctgcctgaccaaa
ggggcagaagaggcttctcaggggaagttctgtttgaggtcttcagcagttcaacagctg
gggaaaggtattccaggagcgagtgagtttggatgccatgtgcgttggtggtgtgcttga
agtagagcaaacgggtggaggcaaatgagcctgaaaaggaaagagatgggacaggatcc
tactgtggaagagttttctgtaagcagtgggaagccacagaaggattttaagtgggccat
tcacattgtgttttattttgagacagggtctcactgtcacccaggctggagtacagtggc
atgatcaaggctcactgaagcctcaacctcccaggctaaa >IGR1002a
aggcaaatgagcctgaaaaggaaagagatgggacaggatcctactgtggaagagttttct
gtaagcagtgggaagccacagaaggattttaagtgggccattcacattgtgttttatttt
gagacagggtctcactgtcacccaggctggagtacagtggcatgatcaaggctcactgaa
gcctcaacctcccaggctaaagcaatcctcctgcttcaacctcccaattagctgagagca
cagctgtgtaaaaatttaattttttttttttttgtagagacaggatgttggccaggctgg
tctcgaacttttgggttcaagcgaagctcccatctcagtctcccaaagtgccgggattac
aggcgtgagccactgcacctggcctatttgtgttttagaaaaacaactgctgggccgggt
gtggtggctcacccctgtaatcccagcactttgggaggttgaggcaggtggatcacgagg
tcaagagattgagaccatcctggccaacatggtgaaaccccgtctctactaaaaatacaa
aaaaatttacctgggcgtggtggcatgcacctgtagtcccagctacttgggaggctgagg
caggagaatcacttgaatcccggggcggagattgcaggagccgagatcgcaccactgc
actccagcctagtgacagagtgaaattctgtctcagaaaa >IGR1003a
ctggccaacatggtgaaacccgtctctactaaaaatacaaaaaaatttacctgggcgtg
gtggcatgcacctgtagtcccagctacttgggaggctgaggcaggagaatcacttgaatc
ccggggcggagattgcaggagccgagatcgcaccactgcactccagcctagtgacaga
gtgaaattctgtctcagaaaaacaaaacaaaacaaaagaaacaactgctggagagtttg
tgaaggattagagggagcaagacgggatgctggttgggatggtggttgggagagcagatg
ctatacacacctgtgtcccggaggtggaaagggtcatcagccagaggagtaaccgccctc
tcttctcagctgttttgcttgcactcgtgattggtataaactgagggagcaaatgtgtgt
cctcttattcacgttgcctagtaagtacccaggtgtgcagtgagcatacaaaacatcaaa
acatattttcgtttggctgaactctggctaatcagaaactagaaggaacagacagcttag
agacttaaagttggactaggaagaagttgacaggatggattagaagatagccactttagg
ctgggtacagtggctcatgcctgtaatcccagcactttgggaggccgaggtgggtggatc
acctgaggtcaggagttcaagaccagcctggccaacacag >IGR1004a
aactctggctaatcagaaactagaaggaacagacagcttagagacttaaagttggactag
gaagaagttgacaggatggattagaagatagccactttaggctgggtacagtggctcatg
cctgtaatcccagcactttgggaggccgaggtgggtggatcacctgaggtcaggagttca
agaccagcctggccaacacagtgaaaccccatctctactaataatacaaaaaaatgaggc
aggtgtggtggcaggcacctgtaatcccagctactcaggaggctgaggcaggagaatngc
ttgaanctgggaggtggaggttgcagtgagccaagatcnngccantgcactcnagcctgg
gngncagagcgagantctgtntnannaaaaaaaaaaaaaaaaaaaaaaaaaannncaacac
tttagagagccaaggagagggtgtctgggtacttagggcaaaagcccagttgaggaaacg
ctgggcgtgacagctaactggggattttagtactccacctgggaatggaactcaaacttg
agctaataaattgaatctagaaatcagccccaaggctagagaaagtgcctgccttgctcc
tagtggaagctactagaaactgagaagccaaccctgtgtgtcataggccaggctgtgcct
agctccataaggaagctctgcgttgtgcttagccttgaga >IGR1005a
gggattttagtactccacctgggaatggaactcaaacttgagctaataaattgaatcta
gaaatcagccccaaggctagagaaagtgcctgccttgctcctagtggaagctactagaaa
ctgagaagccaaccctgtgtgtcataggccaggctgtgcctagctccataaggaagctct
gcgttgtgcttagccttgagattcccatccttagataatgtgggcaccctgagattatgt
gaaggagggcagagaaaaaccaagagcagggtcaatgacatggacagcaacaagcagagc
cccttggcatttgtaacagaggtgacccttttgtaactgtagcccaacaatgtttccata
aaagacagccatagatttgagccaaatcatttttttgattcatttttccaataaataatta
ttaccccctagatgccagttacagatagtttattcattggcaaaaggtggaggtatgata
gccaggagggaaaggttcagacttactgtcaatgtcatattccacacacagacaaaaggc
atgtcccatgaagcaggcacgggctgtggctgagtttgctacataaatgtgctcagatga
caagcatcttaactttcacttaatcctgaaggtttttcaccctctgtttttttgttttgtt
tttttttttgagacagaatctcgctctgccgcccaggc >IGR1006a
gacttactgtcaatgtcatattccacacacagacaaaaggcatgtcccatgaagcaggca
cgggctgtggctgagtttgctacataaatgtgctcagatgacaagcatcttaactttcac
ttaatcctgaaggtttttcaccctctgtttttttgttttgttttttttttttttgagacaga
atctcgctctgccgcccaggctggagtgcaatggcacgatcttggctcactgcaacctcc
acctcccaggttcaagcgattctcctgcctcagcctcccgagtagctggattacacgtgt
gcactagcatcccccagctaattttgtattttagtagagacggggtttcgccatgttgg
ccaggctggtcttgaactcctgacctaaggtgatccgcctgcttcagtctcccaaagtgc
tggaattacaggcgtgagccactgcgcccggcctcacccactgtttttataagtatcccc
ctcaatttgtgttctcattgtcttcggaaattcaaaggcttgttgttgtgcatgtttgc
atccagagtccaggactgcctgactgggagtaaatgaaatgttgagttgcatcttgccta
atgaagcttatgtgatgacagacctgcttagagtctgcatgtgtcctttccatggcgtgc
tctaaatcttcctactttcctttaccatcctgtcctcata TABLE 5-continued >IGR1007a
gtcttcggaaattcaaaggcttgttgttgttgcatgtttgcatccagagtccaggactgc
ctgactgggagtaaatggaaatgtgagttgcatcttgcctaatgaagcttatgtgatgac
agacctgcttagagtctgcatgtgtcctttccatggcgtgctctaaatcttcctactttc
ctttaccatcctgtcctcatatacaaactgtaacccactacccatatcctgtggcagact
acaactcacattagccattgaatgcaaatgagcctcaatcaaagaagaaaggaaattaaa
atttacagtatgtgtcttctccggttggcctgaggagcctccatgactctcatagctatt
tattgcccttggcatgctggtattttatgtgggcagggtgaaactggctgtggtcagggt
gagacttgaagcttttgatttgttccctttattttgaaagggttaaaaagatgttacatgt
tttggtgtaattttagtactcatattaattttgtcacatctctgtaagcgaggatgaaaa
gagagtgctcaatcactgttactagatccatattcttacagagaacaagtcttcaaaagg
caagttttgatgacacttgggttttttttccccctttaatttcttttaaataacagcttt
attgagatagaattcacctactacgaaatttatccttta >IGR1008a
tcatattaattttgtcacatctctgtaagcgaggatgaaaagagagtgctcaatcactgt
tactagatccatattcttacagagaacaagtcttcaaaaggcaagttttgatgacacttg
ggttttttttccccttttaatttcttttaaataacagctttattgagatagaattcacct
actacgaaatttatccttttaaagtgtacgagtcagtgcttttagtatgttcatagaat
tgtgcaaccatcaccattatctaatatccgaacattttcatcaccctgaaagaaacccc
acccccattatcagtcactcccatgcctccacacccgcctcccacccacagcctgtag
caatcaatattctattttgcctctgtggattctcctgttctgaataattcatatcagta
gaatcataccatatgtggtcttctgcatttggcttctttcccgtcacatactgttccaa
ggttcatccgggttgtggcctctgtcagtacttcatttcttttattgacaaataatatg
ccattgtatggatatgccactttttgtttatccatcagttgattgacattttggttgctt
ctacttttttttttttttctttgagacagggtcttattctgtcgctcaggctggagtaca
gcagcgcagtcatagcctcaacctcccagg >IGR1009a
ctctgtcagtacttcatttcttttattgacaaataatatgccattgtatggatatgcca
ctttttgtttatccatcagttgattgacattttggttgcttctactttttttttttttc
tttgagacagggtcttattctgtcgctcaggctggagtacagcagcgcagtcatagctca
ttgtagcctcaacctcccaggcttgagccatcctcccacctcggcctctccagtagctgg
gactacaggcatgtgccaccatgctcagctagtttttttgtagagacaggggttttgccttg
ttgcccaggctggtcttgaactcctggcctcaagtgatcctcctgcctcggcctcccaaa
gtgctgggattacaggtgtgaaccactgctcccagccacttctactttttgctattatg
aataatgttgctatgaacatttgtgtagaggttttttgtgtgggacatgtgttcctagttcc
cttgggtatatacctaggattggaattgctggatcgtaaactatttatcctttgagga
actgccaattgttttccaaagtgactacaccattttcaatcactccagcaatgtaggag
ggttccaattttctacatcttcaccaacagttattgtcttttaaatgttatttctttaa
tgaaaaaacttcatttatgcacataacacacacacacaca >IGR1010a
ttggaattgctggatcgtaaactatttatcctttgaggaactgccaattgttttccaa
agtgactacaccattttcaatcactccagcaatgtaggagggttccaattttctacat
cttcaccaacagttattgtcttttaaatgttatttctttaatgaaaaaacttcatttatg
cacataacacacacacacacacacacacacacacacacacacacacacacacacacacac
acacacacacacacacacacacacagacttataatggaaagccgaaagtctccagccc
tgtttcacccctccttagtccaagtcccattcccagcaaaccatcttccattttatttt
tagtttttccagtgactatcattataattccaaagattgctttgattcattatttttctt
ctcttttttattatgaaaactttcaattatgtataaaaggagaatagtataaccaaccccc
tgtacacatccccagctgcaacaactgtcaacccatgaccacttttacccactgttttt
gctttatcagtgttagatgtcatacattgatttccctattgaagaaagagaatttaccta
attctatcacttccaaattttttatagtaaattatttttagttcttctattacctttgtga
ttttgataaatccctaaaccttgtgttcttgttccatcca >IGR1011a
aacaactgtcaacccatgaccacttttacccactgttttttgctttatcagtgttagatg
tcatacattgatttccctattgaagaaagagaatttacctaattctatcacttccaaatt
tttatagtaaattatttttagttcttctattacctttgtgattttgataaatccctaaac
cttgtgttcttgttccatccactgtgcacagtgttatttaactgccctcttgtccatgca
agctggagatagcaatgccacctctcttttcttctgctttcacctcccagccatttcca
gctatagctcttatattattcagtggatagcaatttatagtctgttctccaaccatcatc
aagtcttctgtgctttgtctattggttggttctaagacttgagaatcaagagaatttaca
ttattatgactttaaatatcgttcactgtagagccatatggtgtactgaggattacttct
ttttctgtagactcagtataacaatccttgtgccaatggggggaagaacgttttagacat
ccagttgataccttttctgttcagaaatatatggtaatccatagcactcttggacccaag
gtgtcttatttacatcttgtatggccttgtgttctttaattatcttgtgtgttatgtccc
taactcgagagggaaccctcgaggggaagtggtctttc >IGR1012a
taacaatccttgtgccaatggggggaagaacgttttagacatccagttgataccttttctg
ttcagaaatatatggtaatccatagcactcttggacccaaggtgtcttatttacatcttg
tatggccttgtgttctttaattatcttgtgtgttatgtccctaactcgagagggaacccc
tcgaggggaagtggtcttttcctgttttgctcccatagcatttatagtcttggtaaac
taaattgatttccctaaaagttgcaaaccataatttcatttgtcaagtaaacatagccaa
tacattaaatgccattgctgttagattctatatatctttatttatgatgagttataaa
tataaaatacttaaannataaagctatcaaaaactcataaattaaaatattcagctcga
acactttgaatatttctctctcatgatcgtctttagccttttccaagaagttttccaacgt TABLE 5-continued actctggttggcttccttcacaggacaggaattctgcaaaanaaacatttcattagcttg
cattggtaagcatttgtcttgcctgcctgtctacttgatcaagcctactgtggcacttgt
cacctgaacacttataaaaccaaggcctccagtctagcctgactgggagttgtctctatc
actaggccagcaggttttgcctattttgggtgcatactac >IGR1013a
acaggacaggaattctgcaaaanaaacatttcattagcttgcattggtaagcatttgtct
tgcctgcctgtctacttgatcaagcctactgtggcacttgtcacctgaacacttataaaa
ccaaggcctccagtctagcctgactgggagttgtctctatcactaggccagcaggttttg
cctattttgggtgcatactacttacacttctagaaatggttactgtataccattacctat
ctgcttttgggtgggtggcgcggggggggagtgcagtctctggagaggtgtgtcacagct
aggtgcttgctcagagggtggaacttgaagatgctggctcagacctgcccggtgctctac
tgggccttctgcatgactgcctggactgctgagagagattcagtcatgtggccctcctgt
gccattaaacagcagcaccgcagcacagcagccctaaaggtgggaaggattccagatgct
accccccaggccactgcttcagtttgaatctcagctctaccatttattaattgtattgctt
aggatgtactacttaatttataaaagcttcagtttcttttgtaaagttgggacaattgtt
tgcctacttgcctgcttcataagataatggagagaattaaaagagagaacatgtgttgtg
ccaagttcctatcccatgacctatcccattgtctacaagg >IGR1014a
agtttgaatctcagctctaccatttattaattgtattgcttaggatgtactacttaattt
ataaaagcttcagtttcttttgtaaagttgggacaattgtttgcctacttgcctgcttca
taagataatggagagaattaaaagagagaacatgtgttgtgccaagttcctatcccatga
cctatcccattgtctacaaggtgataggcccagagagggggatacatgtccttgttctcct
ctaaagccaattaattcctccactcgatattagataacatccactctgggctacaaggac
ttctgccccctaatgattcttcctcttttctgctctcttcagttcttcctgctccactgga
ccattcccccaggtgcattaacatgctgggtataccccaaccttaaaagagcttccctc
actccataaccaccctgcagctgtgggtcagtttctctgcagcctttatagctaaacatct
tcaaagagtgttctgccctcactgttccttcttttgtctcctctcgccaccctatcctcgg
tgagcccactccagctgggctttcttcctgcctctccatttacatcagcctcacccatg
gcctccatcagccaaacccaggggcctttcttggtcctcacctgacctgtcctttcagta
catttgacacagtcaaccctccctccttgagtgtcctcaa >IGR1015a
cactgttccttctttgtctcctctcgccaccctatcctcggtgagcccactccagctggg
ctttcttcctgcctctccatttacatcagcctcacccatggcctccatcagccaaaccc
aggggcctttcttggtcctcacctgacctgtcctttcagtacatttgacacagtcaaccc
tccctccttgagtgtcctcaacgcgttcctgggtaccgccactctccagtgttctcct
gcctcactggtcactcctcctcaggccccttggctggatcctcctctcctgacctccatg
tgttgatctcaggctcagtcctttgatctctcccttctgtcattcagattttcagcagt
atctatctaaggactctccttttttgtattgcaagttctgacctctccccctaagttcaga
cttttctaaccatcttctcaacaccttcacttggctatccaagagccaccttacatgtac
gatgtacaaaattgaactcttgatcttctgctgaacctccagccctgccttgccgccagt
cttttcatctctctgtaaacagtactgaccatcgccagaggggtttgggcaggaacaaaga
ggtcatcttttcctcccctgtatcttaccccctacaaccgatctgtcagcaaatccttct
ggttttattttttagtcatatcccaaatctgttcacctcaa >IGR1016a
ttgatcttctgctgaacctccagccctgccttgccgccagtctttcatctctctgtaaac
agtactgaccatcgccagaggggtttgggcaggaacaaagaggtcatcttttcctccccct
gtatcttaccccctacaaccgatctgtcagcaaatccttctggttttattttttagtcata
tcccaaatctgttcacctcaactgctcccattctgtccacgccaccatcatctctagcct
ggtttactgtggtagcctcccaacaggccatcttgcttcattctgtccacgccaccatcg
tctctagcctggtttactgtggtagcctcccaacaggccatcttgcttcattctgtccac
gccaccatcatctctagcctggtttactgtggtagcctcccaacaggccatcttgcttct
atgctttccccctttcagcctatttaccacacagtagccagactgacccttttaaatcac
gtaaatcagattgtacagtctttgtcctgcccaaagctctgcaggtgttccctgccatac
tcgtggtggaatctaaaggccttgtgtgatctgctgtcctggaaactaccccctcactcac
tctgatccagccacactggccttcctactggtctttaaatacaggaagttagttcatttc
catcctaaggcctttgcatacctcctccttctgcctggaa >IGR1017a
ctttgtcctgcccaaagctctgcaggtgttccctgccatactcgtggtggaatctaaagg
ccttgtgtgatctgctgtcctggaaactaccccctcactcactctgatccagccacactgg
ccttcctactggtctttaaatacaggaagttagttcatttccatcctaaggcctttgcat
acctcctccttctgcctggaatggtctccctagttagtcatgtggcctgctccctcaatt
caaatatctgctcagataatgtcaccagctcctaagtcagccccctcccccatgactctt
atgttctttatttctatgttttttctttgtagcacgtatcactgctggccatcattttaca
tgtttgttttttctaactctcccattagaacattccatgagaacagggactcggcctgcgt
gtctttagtgacacgtcctcagcacctagaaccacacccagcacttgtggaacttcagca
aatacttattgaatggtgaatgaatgaatgggttgaccaagggtgctgcagctcccaag
gagtgttagaagtgaggctgctgtccaccaggagccacgcggccggcttgccaggaata
cagtgcagcttaccaagcccgccaggccccagaggttcctgtcgagccgtttcaggaatc
ggatcagctgcttgtgcctgtggaactgctgtgcagtcgc >IGR1018a
aatgaatgaatgggttgaccaagggtgctgcagctcccaaggagtgtttagaagtgaggc
tgctgtccaccaggagccacgcggccggcttgccaggaatacagtgcagcttaccaagcc
cgccaggccccagaggttcctgtcgagccgtttcaggaatcggatcagctgcttgtgcct TABLE 5-continued gtggaactgctgtgcagtcgcacccaggcagcgagtgtccttctcatggtggctgtagaa
ctgccggagcacagtcgcagccctgcagaaggtttccttctcagttgtgttctggaaaga
caaatgccacagatagcaatgtgccagctccatttggaggatgggagagagattttttcct
cttgatttcttctttccaggaggacaaatggaggtgagtttgctcaactacagacctgtc
ttcaagtattccactgaaggaaggctgcttgccacagacataaacctctgtcaacaacct
ctcccaattgcaaacgcagcagccttctccccagaacctcccagtttcctttctcttgga
ggattttgccgaaagggtacctgaataaagtcatcccatgaggaaaaggcacagtgggga
ctagaatgcaggaccatctgtcgctacagcccacgttctgcgtccgtgtctctataccte
atgagctattctgctatgaaaagtgcccacatgagctctc >IGR1019a
cagccttctccccagaacctcccagtttcctttctcttggaggattttgccgaaagggta
cctgaataaagtcatcccatgaggaaaaggcacagtggggactagaatgcaggaccatct
gtcgctacagcccacgttctgcgtccgtgtctctataccteatgagctattctgctatga
aaagtgcccacatgagctctcagtcaggttctgctcttgttcccagaggttttaaaatcc
agctttccctggaaatcctgcatgcctgttgaataaatgagtgcacatccttggcctga
actctgctgctttggccagcactctccgtgtggctctccccatgggagaggagagcagca
catggcccaagtgaggagctaagacattttgccaggcagcaagagataagtgcacagatc
agggaaaggtgtcctgggagatcagaggaggctctgggagcaggtgccattgatctgagc
cttgggcagagcttctgtaaggggccttttggccccaaatgatgcggagtgagaatctcc
ttggaatgccagcaactgtgagggtctggccacatggctcttcctgggggcccttagcct
tagagaagggaatggacaagagacaagtcattgggaacccaggagagggattgtgtctca
gtctgaacctggccggtgtgtcctctcatttttcactga >IGR1020a
aggggccttttggccccaaatgatgcggagtgagaatctccttggaatgccagcaactgt
gagggtctggccacatggctcttcctgggggcccttagcttagagaagggaatggacaa
gagacaagtcattgggaacccaggagagggattgtgtctcagtctgaacctggcctggtg
tgtcctctcatttttcactgaagaacaaagatgcagaacctggagagggttcttagcttg
agcccagttcctttatccagttcagataaagaaagctatccccagcctctcccccgacat
gctctggtcccttgatactcaaagtgtggtccatggaccagcagcatggacatcactggg
agcttcttagaaatacagaatctcagaccaccctgccccacccagaccctctgaatcag
aagaacagtgacaagatgctcaggggtttctatcagcagcgctgtccaagcagctttcaa
gttcttacatatttttttttctgatgatcaagataacatatatttactataaaggtaaca
tatattcaacaaaaatacattcactcatcccaccagccagaggtaactattgctgttaat
atttggtaaatatcgtcacacttttaaaaatacttttaaaatagggtcaactgttga
tactgttttgtaacttctttactctttacatataccataa >IGR1021a
tctgatgatcaagataacatatatttactataaaggtaacatatattcaacaaaaataca
ttcactcatcccaccagccagaggtaactattgctgttaatattttggtaaatatcgtca
cacttttaaaaatacttttaaaatagggtcaactgttgatactgttttgtaacttctt
tactctttacatataccataagcatttcctaagcccttcggtggtattagagaacatggg
attgagagctgcgtagaaacgcattgcacagtggtactgtcatttgtcaggcccctatcg
tggcagatttttgcttctgtaaataagcggcagtgagtaaactatagaaatctttgtgtt
catctcttatttatgtaggctaaattctaggaatgcagttcatattttaacgtttttca
ggaaagtctagacccagactgaggcaccagaatcccaggctacagaagcttccccttttcc
cctgtggggcgtgatgtcccatgggcagagcggttagaaagacatttacttaatgaactg
actgagagtcactcctcgttcctgattctagttggaaatgtaagagtgtgtcagtatctt
tgggctctgggggcaagaaacagacctctctgggctttgtaggcgagtcgaggtggaag
ggacacgggctgatgggggcggcagatggtgcctgtgtg >IGR1022a
catgggcagagcggttagaaagacatttacttaatgaactgactgagagtcactcctcgt
tcctgattctagttggaaatgtaagagtgtgtcagtatctttgggctctgggggccaaga
aacagacctctctgggctttgtaggcgagtcgaggtggaagggacacgggctgatggggg
gcggcagatggtgcctgtgtgtctggaggtgggcagacatgcatgctgctgcagagggaa
cagtgagattcaagaaaaccaaaaagtcagcccttttgcttcttttaccacaaaaccttgt
gagattttctgaaacgctggcttggagcctggaaattaaacttaattttgacccgtata
tggccacatagtataggaaaaaaccctctaaagatattttttgaaaggactttctaaagga
aacaaggataaaataagaattgaaaagagtctgcattaaatggaaaaactttaaaagaat
gcatcctaagggcagctttagtgcaaggccttaacgttttagttgctctggtatcgcagc
gaggggggcgacactccatccctgccgtggccctggactcctaccaccctgcctgtctagct
ctggctgctgagtgtgtctgccagtggctcagggagtgcacttggacagcctggctgacc
tcacagttcagaactgcttagggagtgactcagaaggagg >IGR1023a
agtgcaaggccttaacgttttagttgctctggtatcgcagcgaggggggcgacactccatc
cctgccgtggccctggactcctaccaccctgcctgtctagctctggctgctgagtgtgtct
gccagtggctcagggagtgcacttggacagcctggctgacctcacagttcagaactgctt
agggagtgactcagaaggaggcctgtccctcccgggaatgtcaggaaacagccacttggg
agatttcttctgtggcagtgactctgtgagagttctaactcggttcttgaccagcctcac
tgaggaccatataaatccagcccgattggcactgcattcattatctcccatcctgcccag
gatagtcagctagtgctgtatatgagaaactccttcaaaaaacagaggtatttgaggttc
attatggaactctctgtagaattatgaactttagctctcttttggtaaataggaaatngct
ccaactacttgtccacccaagaaacccttcatcagccagccagcttgcttcttcccactt
tgctgttcctcagacagccttgacttcatagacaccctgacaggtgttacctgtgaagcc
caggacctagaccagtgccttctttccagcaactgccaagagtagaatgctacccaactt
agagatactaaaattcttgttccccgaagaaataaaatc

TABLE 5-continued

>IGR1024a
agaaaccettcatcagccagccagcttgcttcttcccactttgctgttcctcagacagcc
ttgacttcatagacaccctgacaggtgttacctgtgaagcccaggacctagaccagtgcc
ttctttccagcaactgccaagagtagaatgctacccaacttagagatactaaaattcttg
ttcccccgaagaaataaaatcaataggctggattttggaaagatgttttctttgggaaca
caaagaagtaccttttcctctgcataccacctttgtaggttttttgaaaatagcaacattt
cactgttctgaaatatcttaacatgtaagtaagcagtgctgaatcttcgagggaagaaa
agagtgaagagtgagatcgtgaactccaggaggatgaagttcaggggaggcaaatgagac
gggtaagagtgaaggcaggcagtggggattattctaggagatgtttgtgtgtgtgagagg
gaggtgagtgaggactgagtgaagaggggagttaaggacgggagggcagcagtgtcctgg
cctgcacccgggggtcttccagaaacagcccagatggattgcccagactcggcatcctg
gatggtttgatcctttccaacccggtcccctccttcttagaatcatcgcttctctgcacc
tgttcttgcttttaatcgtggttatatcatctcacaataa >IGR1025a
tgaagaggggagttaaggacgggagggcagcagtgtcctggcctgcacccgggggtcttc
cagaaacagcccagatggattgcccagactcggcatcctggatggtttgatcctttcca
acccggtcccctccttcttagaatcatcgcttctctgcacctgttcttgcttttaatcgt
ggttatatcatctcacaataacactttgcactaactcaagagctggattccaatcaacct
tgcaatcaccttcagaatcactttcatatcttcacatgtggaaactgaggtgcagagagg
tgtgaagatgtgctgaaggccagccacacagctagtcagtggcagagctgggtctaaaac
cacaggcagtcttacctccaggccctcagccctcaccttcctcaggcctggcttctag
tgaggtggcccttccttggctttgttagagccttctcagcagtgccacaggcctccaga
gacccagtgctcaacccggtggactcttggcttctagtaggagccatctcggttggatgg
acttggagattttatacacacacacacacacacacacanananatacananananata
natacanacananatatananacacacananananananacacacacacacacacaca
cataaactgttgcccaggtgcagtggctaatcccagcact >IGR1026a
tggactcttggcttctagtaggagccatctcggttggatggacttggagattttatacac
acacacacacacacacacacanananatacananananatanatacanacananatatan
anacacacananananananacacacacacacacacacacacacacacataaaactgttgcccaggt
gcagtggctaatcccagcactttgagaggccgaggtggacggattgcttgagcccagaag
ttcgagacaagcctgggcaaaatggcaagactccatctctacaaaaaaatacaaaaatta
gccaggcgtggtggtgcacacctgtcgtcccggctacttgggaggctgaggtaggaagat
agcttgagcctgggaggtggaggctgctatgagctgaaatcgcaccactgcactccagcc
tgggtgacagaacaagaccctatctcaaaaaaaaaaaaagtgtgtatttgcccttcaga
atctcatcctgtatcggactcccgggataactaatgaaatgagatagtccagctaaaggc
ccgaagagcagtttccctcatgaagcaggatgggccctgttctatggtctgggtgctgga
gtgtgaccctgcccaacacacagggcttcactcctggccatatcatctccctagtttgca
tggaaagcaggtagttaggagaccactgtgaaattgaggc >IGR1027a
tcccgggataactaatgaaatgagatagtccagctaaaggcccgaagagcagtttccctc
atgaagcaggatgggccctgttctatggtctgggtgctggagtgtgaccctgcccaacac
acagggcttcactcctggccatatcatctccctagtttgcatggaaagcaggtagttagg
agaccactgtgaaattgaggctttggggctttcattctcagccgtgtgtttccatgaaaa
caggaactgaaatgcacaaaactattgatacggctgtagtcatgtgtttgtcagagaaaa
tgcactatcagctgtcaaatctatctcctcccactacagatagaggggtggggtgaggc
agcacaggaggcagagaggcgaggtgcccaggcagcccgaagcagggatgtgctggacgc
tgcccagcaggatggttccagaccgagctggaggggagttcggccggccagagcaagctg
aggagctctggacggcgagcccccggaacccagaggggctgttaggtggccaggctgtggaa
gaggaggggctctggcgataccttttctgttgccataggaagtctcttagacaaaatgaa
agctccctcaacctgtcatctcaatatctgtttctgtgagagtatttggttttttcagaaa
tgtatgggccagaaaaattctctcattcaacaggcattta >IGR1028a
ccccggaacccagagggctgttaggtggccaggctgtggaagaggaggggctctggcgat
accttttctgttgccataggaagtctcttagacaaaatgaaagctccctcaacctgtcat
ctcaatatctgtttctgtgagagtatttggttttttcagaaatgtatgggccagaaaaatt
ctctcattcaacaggcatttattgagtgcctcctacgttccaggcactatgccaaagcta
agtaaaacccaagagggcttttctttgaccaggatctgagtcaggactacagcatgtaag
ctttctattacatgtcttctaaatcaagtgaaaccagaaagaccaaaacatgcttaagag
taaagatcagacttctcgttctttgaaaacatctaacaccttagagttaatttgggcccg
ctcgtttttccattagacaagtttcttgttcagacattttgggggatggatcncccatttgc
taaaacagaccgtgggacggcttcttaccttggaggcagcaaagatgtctgttacggtca
actcggtgcacagagtcttggtccaggcagaaatgagagagcaagagacagagttaacct
ccaaccggacagagaagtccttgatgagcagctctcactccctccaactgaggaaacttc
ctacaaaccctcagaaaaagagtggcaggggagaagcct >IGR1029a
gcttcttaccttggaggcagcaaagatgtctgttacggtcaactcggtgcacagagtctt
ggtccaggcagaaatgagagagcaagagacagagttaacctccaaccggacagagaagtc
cttgatgagcagctctcactccctccaactgaggaaacttcctacaaaccctcagaaaaa
agagtggcaggggagaagcctcgctgtgtgccctggactgccaccaaccaccagttccaa
cttctctagcagctgttaacgttttcatgcctagaaatactgagagcatcaccagaacat
ctggagagatggtgccagataggtactcaccttctgctctgtgaggctgttcaaagttttt
gatgatctcctgtaaggtgatatcgcacttgtgtccgtggacaaagttgccggcacatgc TABLE 5-continued tagcaggaagaacagagggggaagcagttgggaggngagacccattaataggtgtcgatt
tgcagtgacaatgtgagncaattagtttatcaggagaagctaacgatncaatgctgacaa
agatatctctatatatagatttaaaattgctgaaaccgagggaaaatgagtttacattgg
aaattttcgttacaccagattgtcagtcacttggggccaatcagcacctctcttccagga
gaaaaaatgcctcacaaacaggtaaaatgttcctgtgaaa >IGR1030a
aattagtttatcaggagaagctaacgatncaatgctgacaaagatatctctatatataga
tttaaaattgctgaaaccgagggaaaatgagtttacattggaaattttcgttacaccaga
ttgtcagtcacttggggccaatcagcacctctcttccaggagaaaaaatgcctcacaaac
aggtaaaatgttcctgtgaaatcagaccaataggaaaatgaaacctttttaaaaaattaa
ctacaaagtttcagcataggaaattacaccataatttgctctttagattaatcttatcag
cttggggctgctgctggcttttttgctttgcatagaagggagaggccacaggtgtccgaat
ttgttgtaatgcagtcctcctggggaaagatagagtaatatcaagaaagttttacttgaa
aagtattttaacctggcttcttccaagtacaggtggcatcttggaaactgtcctgtcatg
gaaaagctgatctggggctccttctctgcatagaggcagaataacaggcagactctccta
cccagcactgggnacaatgttctcccaagtttaggtgttttgagaaggacaggtcgta
tcaggtgaggcctagtttgggtcccagcaggtccataaggtccttacccataaggaagcc
cttggcaaggtaggtctattctgaggtttcaggaatgact >IGR1031a
ccttctctgcatagaggcagaataacaggcagactctcctacccagcactggggnacaa
tgttctcccaagtttaggtgttttgagaaggacaggtcgtatcaggtgaggcctagtttg
ggtcccagcaggtccataaggtccttacccataaggaagcccttggcaaggtaggtctat
tctgaggtttcaggaatgacttttttttttttttctgagacagggtctcactctgtca
cccaggctgaaatgcaatgttgtgatcagggatcactgcagcctcaacctcccaggctca
agtgatcctcccacctcagccccctagcagtaggtgcgtgccaccgcaccatgcctggc
tcattttattttatttttttgatagagataagagtctcactatgttgcctaggctcatc
tcaaattcctgggctcaagtgatcctcctacctcagtctccaaagctctgagattacag
gtgtgagccaccatgcctggccaggaatgcccactttttgaatggaacctaaacacatcc
tcagctaattaggaaaaagagctacagtcttaccaacttacaaatcagccctcctagtca
gtgccccaccacccgccctgcttgtttttattgaattcatgtggacacaataaggtgct
cattgcctcaccccagcagtgaacgtaaggaccccaccac >IGR1032a
gccaggaatgcccactttttgaatggaacctaaacacatcctcagctaattaggaaaaag
agctacagtcttaccaacttacaaatcagccctcctagtcagtgccccaccacccgccct
gcttgtttttattgaattcatgtggacacaataaggtgctcattgcctcaccccagcag
tgaacgtaaggaccccaccactcactcaggtgcctgggccctgtgcaaggccaccccacc
tcccagtaagggctcatgggcagcaggattcttgggcctgcctgcccctgcttttctc
ccagaaccttccttccttggtctctgaccttcttttccctatgaatttctttttttttt
tttttttttttgagatggaatcttgctctgtcacccaggctggagtgcagtggcgtgatc
ttagttcactgcaagctccgcctcctgggttcatgccgttctcctgcctcagcctccccg
agtagctgggactacaggcacctgccaccacgcccggctaattttttgtattttagtag
agacggggtttcaccgtgttagccaggatggtctccatctcctgacctcgtgatccgcct
gcctcggcccaaagtgctgggattacaggcgtgagccactgtgcctgggcctcccta
tgaattattctggaagatcatctaaaaatgtgtgttgct >IGR1033a
acctgccaccacgcccggctaattttttgtattttagtagagacggggtttcaccgtgt
tagccaggatggtctccatctcctgacctcgtgatccgcctgcctcggcctcccaaagtg
ctgggattacaggcgtgagccactgtgcctgggcctccctatgaatttattctggaagat
catctaaaaatgtgtgttgctaaggttttgcctctgttccacttcccgccccccctca
ccacccctgccccatactctgtcacccaggctggagtgcagtggtgatcatagcttac
tgtagccttgatctcctgggctcaaggcattctccagcctcagcttcccgagtagctggg
attacaggcacatgccaccacgcctggctaatttctgtattttttttttttttagtag
agatggggtttcaccatgttggctaggctggtgtcgaactcctggcctcaaaatgatcca
cccacctcagcctcccaaagtgctgggattataggcgtgaaccaccatgccggccaagg
ttttgcctctgttttggatctttcttcccttattattattattattaaattgacaaata
agtattgcacatatttgtgctgtatgatataatgttttgaaatgtgcatgttatggaatt
gctacatcaagctacttatacaatacttcacatatttatt >IGR1034a
gtgctgggattataggcgtgaaccaccatgcccggccaaggttttgcctctgttttggat
cttttcttcccttattattattattattaaattgacaaataagtattgcacatatttgtg
ctgtatgatataatgttttgaaatgtgcatgttatggaattgctacatcaagctacttat
acaatacttcacatatttattttggtaagaacatttaaaatctactctgtgatttattt
atttatttgagatagagtcttgctctgttgcccagactggagtgcaatggcgcagtctc
agctcactgcaacctctgcctcctgagctcaagcaattctcctgcctcagcctcccgagt
agctgggattacaggtgcctgccaccacgcccagctaattttttgtattttaatagagac
agggttttaccatgttggccaggctggtctcgaactcctgacctcaggtgatctacccac
ctcagccctgcaaagtgctgggattacaggtgtgagccactgcgcctggcctgtcttca
tgattttaagtatacaagacattgatatcaactgttgtcaccatgtcgtacaatggctc
tctttaacttaactcctcccagttgaaatttttatatcctttgaccaacatcttcctgatc
accaccctcccagccctggtgaccatcatcctactctct >IGR1035a
tgggattacaggtgtgagccactgcgcctggcctgtcttcatgattttttaagtatacaag
acattgatatcaactgttgtcaccatgtcgtacaatggctctctttaacttaactcctcc TABLE 5-continued cagttgaaattttatatcctttgaccaacatcttcctgatcaccaccctcccagcccctg
gtgaccatcatcctactctctgcctccctgagtttggctttttatatttcacatatgcg
tgagatcatgtggtatttgtctgtctgtgcctggattttttcacttagcataatgtcctc
caggttcatccatgttgtggtaatgacagcgtttccttcttttttaaggctgtatagta
ttccactgtctatatatagttttggatccttatcgcagtgcctcaagttctgtgaaggaga
gaatctggataattgtatcaggaggtccttagaccatatttaggatccttccattgggac
tgggcagcaaggttaccaaactaaatgcagtggcttcagatgccaaaccacctgagatga
gccacacctcacaggtgaggggtatggtcccccacaacactgcccttgcttcagacgcca
gctgcacattcaggggttcccagcccaccctcactgctgactggctgcaaatctgggagt
ttccactaccctcaggttccagaatgcactaggatgact >IGR1036a
actaaatgcagtggcttcagatgccaaaccacctgagatgagccacacctcacaggtgag
gggtatggtcccccacaacactgcccttgcttcagacgccagctgcacattcaggggttc
ccagcccaccctcactgctgactggctgcaaatctgggagttttccactaccctcaggtt
ccagaatgcactaggatgactgacagaactcaggagtgctatacgtaaggccacagtt
ttatcataacaaaagcattcaaatcagaaccagccaaaagaggagacacaggggcgagat
ggaggaggggcccaaacacaaagctctcattgtcttcccccgtgtggcgtcagaggcatca
ccttctcagcactttgacgtgtgacaaaatgctgactatttctaagcagggaggctcact
tgagctttgggtccagagttttttatttgagtcttatcataggtgtggttgatggact
cattggccactgggttgaactcatcttcctggtctccttccgggaggccaggctgatatc
acagaacctcagtggcgtggccagcccctccatgtcgtattgtcagcaaaaactaccta
gggcccaccatgagtcacttcactcgcataaactctcagagaccaccatgaataataaga
tactcctatcacttgggaaatccctaggaatttggggcta >IGR1037a
ctcatcttcctggtctccttccgggaggccaggctgatatcacagaacctcagtggcgtg
gccagcccctccatggtcgtattgtcagcaaaaactacctagggcccaccatgagtcact
tcactcgcataaactctcagagaccaccatgaataataagatactcctatcacttgggaa
atccctaggaatttggggctacctcctgggaactggtgacaaggactagccacgttgttt
actccaagggtttgtagctggtaggacctcccaagagccaggacaaaggccagacttctt
ggataaaggttgattcttcactgcacaaactggaggagagttatgagaagagcaggtggt
tgcttccaaagcaggtgggacttttggatccgatgaactattatgtggaatgaagtacag
cagcggttccagttaacacaggaggagctcatcaagctgcggacttgctgggtggagag
cttctgccaaataggttctcaaggagagtcggggatgcagaaggggagctggtggggagg
gcggggttctgggcgtctgtgggggcagtggaacagccatttatgtgtccatctggtgt
ttttctaagcacccactaaagggcagaccctgggcttgaggctctgagggcagagctggt
gagtgaaaagggaatattaggtgggcaccttcagctcaga >IGR1038a
caaggagagtcggggatgcagaaggggagctggtggggagggcggggttctgggcgtct
gtgggggcagtggaacagccatttatgtgtccatctggtgttttttctaagcacccactaa
agggcagaccctgggcttgaggctctgagggcagagctggtgagtgaaaagggaatatta
ggtgggcaccttcagctcagaagcagaatccagcttgttttgtttgtttcaatggtgaaa
tgaggccaaagatgaaaggataaactgtccagaacattcgagagtgaccaggagtctccc
cagagggcagaagtgggggatgggccatcctcgcctgcaggacagcaccatggcagctg
caggtgcggcaggtgggtagagatggggaaggtgggtgcctgcattgtcagggacaaaga
ggagggcagtgatcaccaccactaccaccactgcgaaggagtctcccgagcctgcagggcc
atgggcagtgccttggcggggtgtggtgggcctgacaccaaagttcaggagggaggttga
atactgctgtctctggctgtgtcggtcacaggccccttcccctcccctgtgtgagagctg
agaaccagcgccggcccctccatggatgcagagttttccttcaggccctggaacgtagc
agttatgagcactgcgtttgggagtccagcaaatgagccc >IGR1039a
ggtgtggtgggcctgacaccaaagttcaggagggaggttgaatactgctgtctctggctg
tgtcggtcacaggccccttcccctcccctgtgtgagagctgagaaccagcgccggcccct
ccatggatgcagagttttccttcaggccctggaacgtagcagttatgagcactgcgttt
gggagtccagcaaatgagcccttatcaactctgtgaccatgagtagatcattaactctct
ctgggtctcgattttctcacctgtgaaatgggaataatgtggctcttccttgtgaggagc
aagtgagtggttccatggaaagtacttggcatgtgtcatccagaaaggggtctgttaac
agaggctgctatagtacacggtggctaagagagcggacgctgggcccaggtggtctgtca
ggcctggctgctgtgcctcctggctgtgtgaccttgggcacgctactcagcctcatctgt
gaaatagggtcatagctgtccctgtctcatgaagttgctctgaggaatgaatacattta
aagttttcaagtatttagaatagtgcctggcacacagtgagtgtgatgatgataatgatg
actcctatcttgagttgctgaaatgactgatgcttcatctattaggcaagcccaagtctg
gacagggcagtggagatctggccagacgggccctcccccac >IGR1040a
tccctgtctcatgaagttgctctgaggaatgaatacatttaaagttttcaagtatttaga
atagtgcctggcacacagtgagtgtgatgatgataatgatgactcctatcttgagttgct
gaaatgactgatgcttcatctattaggcaagcccaagtctggacagggcagtggagatct
ggccagacgggccctccccacaggttcctcctggatgtgcctcctccgtctttgagttgc
cgtccttgtttctggtgggtcacggtctccacactgcagcccgcctactttagtatctgg
attcattacagggaacagacacagctgtgggtgctttagtcaggaaaggatttcatgcag
gaaagtaggtgcttctaagaatgtcaggagggctggaggggcaggctccaggctgggccc
agaaccctaaagacctgacccactcagcgagccacccctgaggctgcagtgccgggattc
caaagctgctgcctctgctgacccccctacactgtgagtctgctccaggagactcccggtc TABLE 5-continued tgacttccacaccatgagtctgctcaaggacaccccctagtctgaatgaccaggtacatgg
tatctgccgccctcccctccacagcttgtcagccttcatctaattggaaaagccagatgc
tcgcttcaaaggagtcagaaacgcggcagtcaactaggag >IGR1041a
gaccccctacactgtgagtctgctccaggagactcccggtctgacttccacaccatgagt
ctgctcaaggacaccccctagtctgaatgaccaggtacatggtatctgccgccctcccctc
cacagcttgtcagccttcatctaattggaaaagccagatgctcgcttcaaaggagtcaga
aacgcggcagtcaactaggagaaaggaatacaggtcgcacaatgcagcccagtctccacg
ggcctcgttcattgatgcttgctgtcccagccattcctgtggtccgagtcggtgaatct
cacctccctcctcttctgtcagtcctgcaggccagcacccaggagagtgctttccaaccc
ccacaggcttagtcatggaaaaaggtgagacttctctgagggaggggcacttaagcagag
ttagggatgagccggctttagccaggagcaggggctgcagggtggggtgagtgcgggcaa
gggacagcaggtggaaggccccgaggtcactgaagagagggctcccaggaggggagcacg
ggccgaggggacccagccagagcattgcaggcgcccgtgacagaggcagctggcgcgaat
cggtgggatggtggcaggagagctgtgggctcttgagtcatttggcccagcacagtgt
ctaggttaagacctggtgtcttggtgcccacgggacctga >IGR1042a
cccgaggtcactgaagagagggctcccaggaggggagcacgggccgaggggacccagcca
gagcattgcaggcgcccgtgacagaggcagctggcgcgaatcggtgggatggtggcagg
gagagctgtgggctcttgagtcatttggcccagcacagtgtctaggttaagacctggtgt
cttggtgcccacgggacctgactggttctgaatcccagctctgggtgaccttggaaaagt
tcccccatccaggcttctctgtaaaactgggctgattacaggggcgagggaatactatag
aaggtgacaaatatgaagtgtttggtgtggtgaccggcatattgcaagccccccgaaaat
gccagcaatcaccatcaccaccaccatcatcattaatagcacttggaagtgactgaatgt
ggggtgagggagagcaggaagtcgcaggtggccccaggtctctggcttggggaggaggc
aggggagagggcaggcggcgggtggnagccaccagctgagggctgctacgggccatact
ctgagaacaggggagggtccagcctgcaggcagtagacatggaggtgactaagccaagg
ggaagaacacagtgttgctggaaaaagggggtcccgattcagaccccgagagagttcttgg
atctcgcacgggaaggaattcaaggtgagtcgtggtgtgt >IGR1043a
gggtggnagccaccagctgagggctgctacgggccatactctgagaacaggggagggtc
cagcctgcaggcagtagacatggaggtgactaagccaaggggaagaacacagtgttgct
ggaaaaagggggtcccgattcagaccccgagagagttcttggatctcgcacgggaaggaat
tcaaggtgagtcgtggtgtgtggtaaagaaaggatgtagaaaactactcagagtagggtg
tcctcagaaagcatgagcaggaacgccttgtctgcttaaagcttttcttatataggggtc
ttgtctatacaaaagccaagctacattatgtctatgtgcaggtgggctgacagtgtcaca
aaatttagtactttgttgatttaaataatgttttatccttggccttttagtgagtaagta
catcaaagcattactgtaaatagcttgaaagcatatattgttatgagacatcaggacacc
cagacattctgctgttgtaggagtttgtccttgcgggcgtgactaaactgcttccttggc
gtaaacatctcatgaccatgggtagtgactggcaaggaatatgcctagctagttttaaga
tggagttgatttaaaatggtgtcaccctggctctcctccactcctgttgacctaacaat
atggccaaggggtgagagaagacaggggacaagaaatgag >IGR1044a
ggagtttgtccttgcgggcgtgactaaactgcttccttggcgtaaacatctcatgaccat
gggtagtgactggcaaggaatatgcctagctagttttaagatggagttgatttaaaatg
gtgtcaccctggctctcctccactcctgttgacctaacaatatgccaaggggtgagaga
agacaggggacaagaaatgagccagggcactcctgcgacactggaaggtggtgaggcagg
gtgcagagtccaggcatgagagaggcccagggaggaggagcagtggtcagcggcagcaat
gttcctcgtaggtgaggctagataagggcagacatgcgttgctgcacggagtggagttga
taatcagtgacctcatgagatatctgagtgcagttgggggcagtggaagtggccagatga
ggtggaactcagtatgggcatctgggagggcagctgtgtttgggctgcaggctgcgtcgta
ggttgtcagctgtgttctgaatgggacacaatcaagcacaggctgccccagctcagcgag
cggcagcttcatccttgcagttgttcacacacaacacgggaagacctcacacgctcatat
ccaagccaccccaaagcctctccttttcactgatgtgacatctcggattggtggtggtggg
gaaggggcgggggtagagatggaacaaaattgacaaaact >IGR1045a
aatgggacacaatcaagcacaggctgccccagctcagcgagcggcagcttcatccttgca
gttgttcacacacaacacgggaagacctcacacgctcatatccaagccaccccaaagcct
ctcctttcactgatgtgacatctcggattggtggtggtggggaaggggcgggggtagaga
tggaacaaaattgacaaaactggccatgagttgctcattgttgacgctgggcaatggatg
cttgggagtgactttcgtgtatatttgaaattttctgtaatagaagattttaaaattgta
attgcatagcaaatgtaaatattaacatatatgcacatttatatattatatatttanatc
tatactttatggattatataatatactatttaagtaaataatgtatacgatagcagtata
atgtatacatgcatcttacacacacgcccctctccagtcctccactaccacaagcaccat
cgctccccaccagcatctctgcaggcacctggcgctcatctccctgctccgccttcgcc
ctgcgttgcgttctccacacagcagccacggtgactttgttaaaatgtgagtcagacaca
atcactccattccacttagaatgaagcccggtcctggcctctgagggccctgctgggntcc
tgctgcccttgccgtggcctctgctccagcccgagggcca >IGR1046a
tgcaggcacttggcgctcatctccctgctccgccttcgccctgcgttgcgttctccaca
cagcagccacggtgactttgttaaaatgtgagtcagaccacatcactccattccacttag
aatgaagcccggtcctggcctctgagggccctgctgggntcctgctgcccttgccgtggcc
tctgctccagcccgagggccacccgtgagtgctgggaagggcatcccagctcgctcttg TABLE 5-continued ctcaagaccttagcacctgcagttccctttcccttgatgactttgccccgatctgtgcat
gggngtccccctnccccttgtttcgtcccgatctctgttcccatcttatctcatgggagg
atttctccaacctcctcgcataacacagcactctccctgctgtgcagccccggactgttc
tatttcccacggtagcggctaccaccgcccgacacactgagtgttctctcgttggcttat
tctgtctccctgctagaagcaaccttgttttgtttagtggaccccagcacctagagcag
ggtctggcacccaggcaaggcctcaatccatacttgttgaatgaatgagtggagctccat
ttccacggagccactgagacgtggctgaagtaacaacactagaagtcagggacacagctg
gggcttgaagctgggactagtttcaccctgagccccggc >IGR1047a
caaccttgttttgtttagtggaccccagcacctagagcagggtctggcacccaggcaag
gcctcaatccatacttgttgaatgaatgagtggagctccatttccacggagccactgaga
cgtggctgaagtaacaacactagaagtcagggacacagctgggcttgaagctgggacta
gtttcaccctgagccccggctatatgctctgcctgtgttcctgagaggggaggggatgg
ggcccagagcacanacacatggagggcccatccaagggcacagggaccgaggggaggag
agaaacgaggctggcaggcagtggcatagactccgctttgcggagctgtggggaagtagc
tctgcaggctgttggcttctcttgcctttcagaagcaggtggaaggtccttctcccaaga
gaggcagagctgctgaggagtctgcaggaatgctccatctgtccccatagtgttaatgtc
acttcagcctcagagctagatgggcggcctacccttttccttcccactcccgctggctcc
tgtgccctggcaggccaggcctagtgaagaccccccaagaaggcagcaccttcctctgtc
tttggcaatgtgggatctgatgggtccaagagtgcccaacccatgggaggagcggtgcta
gtcctgtctggctgaggggctgccttgcaggcccctgcag >IGR1048a
atgggcggcctacccttttccttcccactcccgctggctcctgtgccctggcaggccagg
gcctagtgaagaccccccaagaaggcagcaccttcctctgtctttggcaatgtgggatctg
atgggtccaagagtgcccaacccatgggaggagcggtgctagtcctgtctggctgagggg
ctgccttgcaggcccctgcagaccccccacctcctctcccgagaggggccggctccccaggg
aggacttaggctggtctgaggggtgctggtgctggtccagccgggggatgctgcaaccag
gtctcctcactggcctgtctcggtccacatcctccatggagcagacatcacgttcatgtt
cttttttgcttttaaaaatgaaatttatccttgtctcccattggaaaatgaatgcatgct
cattatagaaaatgtgggaaacagatcagaagaaagaagagtaaataaaaattgcctttt
ccaatgtggcatcaccacagctcctctggcacagggccctggggctgggcagggagttgtg
gactgtgtngccaacaggccatcgggctgtgggtctacaggggatgccatcggtggcttg
ggccttcctcccttgagggtttgggaaatggtgtccagcccccgcacagttgtccacag
tgatgcagagagtggagctgacgagagttgctatatttaa >IGR1049a
gctcctctggcacagggccctgggctgggcagggagttgtggactgtgtngccaacaggc
catcgggctgtgggtctacaggggatgccatcggtggcttgggccttcctcccttgaggg
tttgggaaatggtgtccagcccccgcacagttgtccacagtgatgcagagagtggagct
gacgagagttgctatatttaattttggtgcctgcgtcacctctgaccacacagcagcgtc
tgcccaggcaggcagcacatggctgggggtgtttctgaacgacgctgtgagagaatcact
ttccccaagaaaaggtatagcagagggaagggagagacagcaacagaaagtgaggtcgt
aagtagaaaattgcttctgggatttcaaatggctttgtcatgggccctccccttnctgcc
gagaaatcagttgatctgggaaagtttgttgcaaaccccttgccctcttgctttgggtgg
agctgagaaatgaatgaagataatggggctttatgagtgtgggggagggtagctgaggag
acagccaccagtcctgaccccagcttggaccccctagaaaggccagataggagctggccag
tgtgtccctggccaggctgtcctgtctggaacatagtcagcctgncccccagccggaccct
cttagaagggaggcaggcgaagtgggaaacaggtttggag >IGR1050a
ataatggggctttatgagtgtgggggagggtagctgaggagacagccaccagtcctgacc
ccagcttggaccccctagaaaggccagataggagctggccagtgtgtccctggccaggctg
tcctgtctggaacatagtcagcctgncccccagccggaccttcttagaagggaggcaggcg
aagtgggaaacaggtttggagtgtgttacaatgcaccagctagatgaagggcataggcag
aagacatttctctttgaccctaatgaaaaagcgataagccgctgggccaggtgaaggcca
ggcttcaagctgctgcctcggtcacaaggaaataagatgcgggcctggtccccttggggc
ctgctccttctcgtcctgcgcaggacagggggccagcctcggagaaacctgccaagtgac
tgggagcattttctgacacctcatctgagcagcaaactgaggtgtttggtgccgagttca
ccggaaactcgcgtgtgtctcacttctcactcaagcccagcctctcttccagtgaaacct
cctgggctggggttcccgaggtgccaaggggctccccgccctgggccccatggccagcat
cttcctcccactcaccaagcactcttctcccttctcaaccccccttctctctgagtcctgc
tgagggcttgccttgtttatgaaagaacttaggccacgtg >IGR1051a
tcacttctcactcaagcccagcctctcttccagtgaaacctcctgggctggggttcccga
ggtgccaaggggctccccgccctgggccccatggccagcatcttcctcccactcaccaag
cactcttctcccttctcaaccccccttctctctgagtcctgctgagggcttgccttgttta
tgaaagaacttaggccacgtggttagagaaaactcccagcaaacaccaccagggctcagt
cccagggagggaggttcccagccacagttgcagtgctgacacttacctaccttgttctg
tcttcctttctcattcctgacagggccccttccctgtcgccaccagctgcagcttggttc
tgtggctcagtaaggtgtcactcatccctggagagccccacgccctctcagcccagggc
acactgccagtgaccacaggtccccttcctggggagcagcctggaaggtgtgagggaca
ggagctcggcggtggctgaggaagtggcgagctgcagacccctagtgggccccgggacgg
ccatccgcactgtgcacctgcctcgcaggctgtcctgaatgtgtggctcagagcacgcc
ttggaggatcccgaggaaccttgccccacatcagcctcaattccagtctttgttcttgag
ggagtcacgtggaatttcactggaagggtttccatctttc TABLE 5-continued >IGR1052a
ggaagtggcgagctgcagacccctagtggggcccgggacggccatccgcactgtgcacct
gcctcgcaggctgtcctgaatgtgtggctcagagcacggccttggaggatcccgaggaac
cttgccccacatcagcctcaattccagtctttgttcttgagggagtcacgtggaatttca
ctggaagggtttccatctttctggataggcagggcaatactttggctgggcagagaggac
atgggtcaaagatgatgctactgggagatagattctaggtcttgtttacaaagtcatta
ccctccgtaaatatccttccagccttaaaccctaggctctggatggagaagaatgccgag
accctgactcccaccacctcccctggcttccaagactctctcgtcctttgcggaagcag
ccactgctcacctccagaggggaggccctcccgagggaggacatacagctcccccaaccc
gaccctctgttgtttctacagagttctttcaggggctaaatcttgagtgcatgtggtgtc
ttggttgtcactagcccaggtgtctgctgtggggtggtcccccgcaggtatttcctcagc
aaacgtggcaggacttaataggcttggcaccagagagccggtcctgtctcctgcccggga
cagcctgctggagacccagctcttgcaccatcaccctctt >IGR1053a
agagttctttcaggggctaaatcttgagtgcatgtggtgtcttggttgtcactagcccag
gtgtctgctgtggggtggtcccccgcaggtatttcctcagcaaacgtggcaggacttaat
aggcttggcaccagagagccggtcctgtctcctgcccgggacagcctgctggagacccag
ctcttgcaccatcaccctcttcaccccacagtcttctctcctctaggccaagtgtcccc
tgcccctgcactgtcaggtttgccttcttccgtcgcctctccctggggaaagtgagtgg
ttctggagtagctggccaccatcatcagcccctggcgaactccctgccacgtcctctgc
tgttgcgtgaatgacacagccatgagcagtcgagggcggctgncttcagggacttctgag
catcactgtggtgttcccatagggctctggctcccagggagggcacctgcctgtcact
acaagtttgagactggttcttgaagaccatcacccactgcaaaggcatccatcctggag
tcaccctctgccctgggcacctcccagagagtcacagtgaaaagtgttgctgacgggcat
ggcctgagctgtggcttggtaaggcccgctggtctctgcactccagctgctgaccaggg
ccatggggaagcaacaagagctgctgaggagtggcctagc >IGR1054a
ttgaagaccatcacccactgcaaaggcatccatcctggagtcaccctctgccctgggca
cctcccagagagtcacagtgaaaagtgttgctgacgggcatggcctggagctgtggcttg
gtaaggcccgctggtctctgcactccagctgctgaccagggccatggggaagcaacaaga
gctgctgaggagtggcctagccagagcccgttcacagaggtggtgcgtgtgtgcaccct
aatggcgagagctgtccagaaatgcaatgggctgcccctcaaatataggtagggaccctgc
ctgtcagtgagagggcccgaacaggttgatgacagttgtacaggggaaaaactccattc
aggacaggtgacatttggnagaaataggnagggtggttaagtgtgtgggctttggagtt
aaagtgaatttgaccccaatcccaacttttgctcctttacctcagatgaggctctgagg
ccccaggacccagtgaggaagtagctacgtgaccttaggcaaaccgcccacgctttctg
agcctcacagttctcatcggcctcctgggttgtgagggagacatggatgtgtgggtggtg
ccagacacagctggccagtcctcaggagatgtgattgtgagacttcctgggtctccgtct
gctcctgatgccctccttgaaccctgacagtctggcccaa >IGR1055a
aagtagctacgtgaccttaggcaaaccgcccacgctttctgagcctcacagttctcatcg
gcctcctgggttgtgagggagacatggatgtgtgggtggtgccagacacagctggccagt
cctcaggagatgtgattgtgagacttcctgggtctccgtctgctcctgatgccctccttg
aaccctgacagtctggcccaagcctctccgtccttgctggtgcagcagacagaaggtggg
gcttccttcaggccatgtcccacccctcgggagctagcttgcattcagcccaggtcactg
caccctaccctcgctgtaatccatcccagtcccctcctcaaccccaccagcctcccgaag
agctcctcagagtcttcagaccacagaccagtgtccccaaaggccaaaatgaaagacaaa
tacaatcaggcctatctgtcaccaactttatttctggcttcagttttgatagtcaatgaaa
caacttgttcaatgtcccctcccccagtgttcaaggtaccccttctatatattaactctttt
gctaacatatttaatatttaaatacnaggaaaaacaataaattactcgttggctgagagc
tggctgctggctggcagacaggagcggctgttctgcccctctcctgaccctgcctcggat
gaggctccgaggccccaggaccccagtgaggtagcagaat >IGR1056a
tcccccagtgttcaaggtaccccttctatatattaactctttgctaacatatttaatatttt
aaatacnaggaaaaacaataaattactcgttggctgagagctggctgctggctggcagac
aggagcggctgttctgcccctctcctgaccctgcctcggatgaggctccgaggccccagg
accccagtgaggtagcagaattctgtacacagtacttattaccagggactcctggngtnc
actgctttagtgctgnggncctgagtctctgaaccctggctccaagtgcnagcagccac
agtcttccccaatcccaacggtgacaaacacactcatttaaataacacacaataataaa
taagaccaagaagaagtgtgcctgagctgctgtctgcctcagttgcctgtgtgtgaagtg
ggtccctgtcccaccacatgtctggcaaggggggcanccactgtaatgctacagtgtgct
ctagggcaggggagggtgtagggacatgtcatccctgggtccaccgagctcagggcct
ggacagaggagggcccaccaggctgagccctgggcaagggaaggctgaggtcggctaggc
tgaanacgggcagcacaggctgaggtctaagctaaggaattttaccctccctaaccctc
cttcccgcctacccaagacattttgacatcagaaagaaa >IGR1057a
tagggacatgtcatccctgggtccaccgagctcagggccctggacagaggaggcccacca
ggctgagccctgggcaaggggaaggctgaggtcggctaggctgaanacgggcagcacagg
ctgaggtctaagctaaggaattttaccctccctaaccctccttcccgcctacccaagac
attttgacatcagaaagaaaatgaatctgcaacttcaatagtcaggtcctgtctctgc
aaataatgatgctttcgaagtttcagttgaacngtccctcgcgaaaaagtttctttaaat
gtaagagcaggtccttacaaactgggccacctcgattttggtgtctcggananatgcaagc
tggaaaactgctgcaggacaaagaggtcagcacntgagtagaanccagaggccgggacg
actcgcacaaaccaggggctttccagggactgtctcattcagtcctcacggaagtccccca TABLE 5-continued tgaggtgggtactgttagtacctctactgtacagatgtggaaattgaggcccaggtagga
gttaggagcccttgagcccagatcctgtaaatcccgaaggccacgtccctgctgccacaa
tggccccaccctgggtgnacacacaccatggatattcagccagcttcccttcagcgagc
ccaggggttggcaggaggggggtgcagggtgggtgtgagagg >IGR1058a
acctctactgtacagatgtggaaattgaggcccaggtaggagttaggagcccttgagccc
agatcctgtaaatcccgaaggccacgtccctgctgcacaatggccccaccctgggtgn
acacacaccatggatattcagccagcttcccttcagcgagcccaggggttggcaggagggg
gtgcagggtgggtgtgagagggtgggggatgccttaccccagctgagaccctgtgcgggc
agaatccgctcagcatcctctgggtcttctcgatggcactgcagcctgacacgttgatca
gggattccagggctgcacagtactgtggggaggggacaccgaggggtcaggccctgcttg
ggcagctgccttttgtgagtctgcaggaagatggggctgagatgcctggcgcaggtgagt
ctgggtggtgggcggaaggggccagattatggcgggagggaggagancacttgaagctt
gcttggaaccccagccatgaagggaggctcagagaagataagcccaaggcctggagcct
ctgccccatcctccctgcacccaaaggtccttaccatgccagctgtcaggttgatgctcc
ataccatgctgccattgcagagcggancctnntgggagcaaagtgacagtgagcagagtg
ctgcaggggttgtgggcctgccctggcagcccaggccag >IGR1059a
gaagggaggctcagagaagataagcccaaggcctggagcctctgccccatcctccctgca
cccaaaggtccttaccatgccagctgtcaggttgatgctccataccatgctgccattgca
gagcggancctnntgggagcaaagtgacagtgagcagagtgctggcaggggttgtgggcc
tgccctggcagcccaggccaggtctgccccagcacaggncccacaagcatccctggtgtg
gcacagaggcaggcctggcanccccctcancattcctgagcttcgtttttctgctttgaaca
gcangcataggggtgaggtcccactgtttagggtcttggagctgagagaaaaaaattgac
accactagtaagggacaagctgcatgcaaggcttgccatagtcagggcaggaggacaggg
gcctgcgggaagggccaggtggggacgagtgaagtaggagtggcctgggccactgttga
ccaagacaaatcagatgggaggcggtggggatctggtgtattaaatgccctgccttctga
tggtgagggaacactgcagttaggagcatggacactctggtgttggccaggcctggcttg
aatccagcctctgtcacttaacctcactgaaccttagcagaatgggttcatcgtacctgc
ctcttgaggtggctggcagtgatgaaatgacacataaagc >IGR1060a
aggcggtggggatctggtgtattaaatgccctgccttctgatggtgagggaacactgcag
ttaggagcatggacactctggtgttggccaggcctggcttgaatccagcctctgtcactt
aacctcactgaaccttagcagaatgggttcatcgtacctgcctcttgaggtggctggcag
tgatgaaatgacacataaagcacgtgcaccaggcctggtgtaagcagtgctcagacatgt
gagctgttactagtggggcaaggagcggactctactaaggaatcctcctgtaagggcggg
cctatgatggtgctggggagaatggctgcattgttatggtcaaaatccagttggcaaatg
ccacatggttctgggagggtgctggccctctctgctgtcctgttcaggaatggctga
gtaggagctggcagtggcagacaaggccaggccaggagagcaggtagtccctggggagtc
tgccagacacctccataggtccatccacagtgctgagcccccagcccagctcctctctc
cctcatggctgggccgggccttggtccatggagattttcctgacctacaggcatcttag
gaccaggcccagcctgctcatgacctcatcttgggaatcacccaccctggagccctcata
gctaggaccctggctagccgacactcaccttctggttctg >IGR1061a
tccatccacagtgctgagcccccagcccagctcctctctccctcatggctgggccgggc
cttggtccatggagattttcctgacctacaggcatcttaggaccaggcccagcctgctc
atgacctcatcttgggaatcacccaccctggagccctcatagctaggaccctggctagcc
gacactcaccttctggttctgggtgatgttgaccagctcctcaatgagctccctgagggc
tgtagagggaggcacagggcctggggaggcaaagccgccaaggcaagtgagagcaatgac
cgtggtcaacaaaagcgccatgaggcccagtgccaacaggagaggattgaggagcggatg
cnnangctgggtggcttgtggccttggcgtcttgtgcagcttttataggcccaagtggt
gacgcctgacaccatggtctctgctttttcaggcactatctagaaaccacatctttactc
atcttgattttactttgtgaaaatccagtgtcgcataaaggaaagagtttgatttctca
tggacttattgagaagggtccagggcagagtttccaagatctgggtgggtttaattccag
cggcaggcaaggggccctgagagcggcgtggcatttgcaatgctgccctgagttccagca
gttttgcctgtgacaaccctgagtacctggacagctgacc >IGR1062a
gaaaatccagtgtcgcataaaggaaagagtttgatttctcatggacttattgagaagggt
ccagggcagagtttccaagatctgggtgggtttaattccagcggcaggcaaggggccctg
agagcggcgtggcatttgcaatgctgccctgagttccagcagttttgcctgtgacaaccc
tgagtacctggacagctgacccaactctgagctcctgtcctcagaccccttttgggtcacc
agaagtgctgagcagatagtcttagtgcactgtgctgtgaccacagtctaccagctatg
ggaatttgggagttttatttttttcgatgaaccagtctcttaaattacttaagtaacact
tgcttggatacaaaattcaaacaggcaatagaagagtaaagttcacttcttttggcttgc
ctaattcctccttggccccactgtgagagggattgtcaaagttcagatttccaggtctcc
actgagagatccagaaagattcagaggtcttttctgggagctttttttggtgtttttttgtt
ttgtttttgttttgttttttggagatggggtctcactatgttgcctgcctaggctggcct
ccaactcccagactcaagcgatcccccacctcagcttccagagtggctggaagtagtgt
gcacgtgtctggcccctttaatttaaagtgtatgggccat >IGR1063a
ttcagaggtctttctgggagctttttttggtgtttttttgttttgttttgttttgttttt
tggagatggggtctcactatgttgcctgcctaggctggcctccaactcccagactcaagc
gatcccccacctcagcttccagagtggctggaagtagtgtgcacgtgtctggccccttt TABLE 5-continued aatttaaagtgtatgggccatccttctgggaaactcttaactgggccaggctggcagcct
tagtccaggtcagagantgtnnnnnntnctagtgncactggggcttggggtgatccctttt
gctcaccagtctctgcaggatcaaccctgccgtctgggggcctcaaatttcccttctgc
agaatgagtgctgtggagggcggctcctgggcttggccctgcagccatgtcgccttttc
ctgctcttccctcnttttcctagaagtcctccagaaaccccacagcagaggccacggca
tttgcctgttgggtgttgatgtcaagatttctcccctacccacttcctccccgaaccagc
gcctccccaggcccctctctgcctgctcaggctccctccgtcctgtcctcgatgggct
caacctcctcacaagggtgtgcttgtgaccctcctcacaaggcatgctggattcccgctc
agaggcatcccaggcttgcccaccctctcttcccacaggg >IGR1064a
tgtcaagatttctcccctacccacttcctccccgaaccagcgcctccccaggcccctct
ctgcctgctcaggctccctccgtcctgtcctcgatgggctcaacctcctcacaagggtg
tgcttgtgaccctcctcacaaggcatgctggattcccgctcagaggcatcccaggcttgc
ccaccctctcttcccacagggaacgtcattcccaccctctctgtccacactcgaagcttc
ccagcccagctgctggctctgactcccagaagtctgcccctttcccctcgagggccccag
tgcctggagtgccgctacttggccgtgtgaccccnctacgggcctgtttcctaatctgta
gtagagggcccacggcatctcccacagggtctccgtgatgggggaaggagcggggaacta
ccttggtctgtgcaactcccggagccccgccgggtgagtcaacgcccctttatcccccat
ggccaccaaaagccctgccgggagcggtgggcaggggcgccccgcgcgtgggagaaggc
gctggcgcggcggttgcggcggcgatggcccgcggagataggggggtggccttatgtaac
gggagatggggcccgataagcgggatctgcgcggccgggccctcctccgcggcctccggcg
gtggccggtccgggaggcaggggtgggcgcgcagaccggc >IGR1065a
gggagcggtgggcaggggcgcccccgcgcgtgggagaaggcgctggcgcggcggttgcgg
cggcgatggcccgcggagataggggggtggccttatgtaacgggagatgggcccgataag
cgggatctgcgcggccgggccctcctccgcggcctccggcggtggccggtccgggaggca
gggtgggcgcgcagaccggccagtctggaagctgcggaggctggacacccgggccagcggctcc
ggtggccggtccgagcgccaggcagggcaagggccggctggacacccgggccagcggctcc
ccgagcgccggtgcgcaccggcgaggggcgggagcggccgaggggccgaggcgcgcacgt
gccgctccagcaccggccatgtcaggccgagggacccccgcgggcccggccgagcggcagc
ccctgccctggagggtggtctccagggaccaaggcgtggcgggcggtgcggagaggcgcg
gcacagatggctacatcagagggtctgttgcttgtttctagattgtcagcggggatccac
tcccgtgcgggtaattttaattaacactaactaccaaagggccgctccgggcacttggcg
catgtggctcgcacctgcctgcaatgcgctgcgtgggccgcccgcttatggccatgggga
gcctcttcgctttgctctggccccgaagcgctgggattgg >IGR1066a
agggtctgttgcttgtttctagattgtcagcggggatccactcccgtgcgggtaattta
attaacactaactaccaaagggccgctccgggcacttggcgcatgtggctcgcacctgcc
tgcaatgcgctgcgtgggccgcccgcttatggccatggggagcctcttcgctttgctctg
gccccgaagcgctgggattgggacctcccttcctcccgaccagctcatcctgggaaagct
gggggttgcttttttcgggtttctctggactctgggtctccgttggcaaagacatgatgccc
agtcaggaggagtaaggcctgagagagttgtttttgtaagtgaaaggatttaattttta
gattttttattttaggaaagttacgaatgcagataattttaaaaatcaagaaggctgatt
atgtaaaacggcagcgctgggaatccgtgctctatgggcctctggcattgctgctcctct
tgtgagtgaggcacttactgccctgctgtgtcccttactgtcttttaaaggttgtttata
ggccgggcgcggtggctcacgcctgtaatcccagcactttggaggccgagatgggcgga
tcacgaggtcaggagattgagaccatcctggctaacacggtgaaaccccgtctctactaa
aaatacaaaaaattagccgggcgtggtggtgggcgcctg >IGR1067a
gccctgctgtgtcccttactgtcttttaaaggttgtttataggccgggcgcggtggctca
cgcctgtaatcccagcactttggaggccgagatgggcggatcacgaggtcaggagattg
agaccatcctggctaacacggtgaaaccccgtctctactaaaaatacaaaaaaattagcc
gggcgtggtggtgggcgcctgtagtcccagctacccaggaggctgaggcaggagaatggc
gtgaacccgggaggcggagcttgcagtgagccgaaatcgcgccactgcacttaagcctgg
gcgacagtgtgagactccgtcttaaaaaaaaaaaaaaaaaaaaaaaaaaggttgttaagaa
aatcacaagaaggaggaaaaaatatatttcctattcattaagtggaggtggaacatcac
aaaggtcttcagcgtcactgtcttcacgttgagcaggccgaggaggaagaagaggagggg
tcggtcttgtcatctcagggtgtggcagaggcaggagagaatccgtggataagtgatctg
tgcagttcagaacctgctgttcaagggtcaactgtgtatgtaaaaaattcagtggaatct
ccaccttccctcacaagtaactattttcttaggtgttgttttttttttttttggtatc
ctattagtttatgtaaatacaagcaactgtgaatatatgg >IGR1068a
ggtggcagaggcaggagagaatccgtggataagtggatctgtgcagttcagaacctgctg
ttcaagggtcaactgtgtatgtaaaaaattcagtggaatctccaccttccctcacaagta
actattttcttaggtgttgttttttttttttttggtatcctattagtttatgtaaata
caagcaactgtgaatatatggtcttatttttcccttgtccctacatgtgaagtggcatcat
atacaccttttgcaccctgttttctcacttactataaaaataatatattttttgtattca
cacttagattgggacatttttatgacttttcttctttgttctctcttattggaactgccat
ttttttttgactatatacctcttggacttgtcctttaattttcttttttattctattttcca
tttaaaaaatttctcttctctgggatattctcatagctttatcttcctgagggtatttga
ttctttgtgtgtgtgcgcatgtgcacatgcacgctaacagcactatgttcttgtttca
ttgatatcttctaagtttccttttttcatacataatctttattttctgcaagttttcttta
aaaaattgttttgaactgggcgcggtggctcacccctgtaattccagcacttttgggggc
cgatcgcttgagcccaggagtttgacaccagcctgggaaa

TABLE 5-continued

>IGR1069a
catgtgcacatgcacgctaacagcactatgttcttgtttcattgatatcttctaagtttc
cttttcatacataatctttattttctgcaagttttctttaaaaaattgttttgaactgg
gcgcggtggctcacccctgtaattccagcactttgggggccgatcgcttgagcccagga
gtttgacaccagcctgggaaacatagggagacttacttctacaaaacataaaaaaaact
tagccaggcatggttgtgcatacctgtgatcccagctacttgggaggctgtgtgggagca
tcacttgagctcaggagtcgaagctgcagtgagttgtgatcacaccacttcactccagcc
tgggtgacagagccagaccctgcctcaaaaaaaattttttttccatcttataggctttcc
ttgcacgttaggtaatcctggattgcctgcacatgttaaaacagggatctctgagggtaa
ttgtgtgggagggggctgtttcctatagggcaggtggctgactgttttcacttggggaac
ctcctgtggcagtttctttgtcgttttttggcaggcaggtcagctcgcgcagaaaagat
tctccctgtctccagcattccagcagcaagggtggagagagggctgggtgggggcctca
gcatctgttgactgttcctgatttcagcatatttcgaccg >IGR1070a
ttcctatagggcaggtggctgactgttttcacttggggaacctcctgtggcagtttcttt
gtcgttttttggcaggcaggtcagctcgcgcagaaaagattctccctgtctccagcatt
ccagcagcaagggtggagagagggctgggtgggggcctcagcatctgttgactgttcct
gatttcagcatatttcgaccgccctctactgtgtctagtgtttcttggtccagatatcct
atccggagaaaaccctgctgcaggagagtcactcgactttgatgaacaaaaatggatatc
taactgtttcttaaactgagtttcaacaactttccttattttcaccccttctcttctga
tgtccttggtcttctcccagttcctgagcattcttgggattctgtaaatcaacataggtc
tcagctggcctaggattcagttttcttgggtcagccaagtagtctgcccaccgtccctcc
actttccacctttcaaacgctggtgctgtcatccatttctcccattttggtgggtttaaa
actttagaaaattcagttactgtcattttagttggttataaagtgggagtttgtgtttat
tccattgttttcatttggaatttatattttaatgtagagaatttataaacaagacaaga
aataagaggcaaacactagtcttgcacccttttccctgg >IGR1071a
ctggtgctgtcatccatttctcccattttggtgggtttaaaactttagaaaattcagtta
ctgtcattttagttggttataaagtgggagtttgtgtttattccattgttttcatttgga
atttatattttaatgtagagaatttataaacaagacaagaaataagaggcaaacactag
tcttgcaccccttttccctggcactataacacctctgtatctttgctatgcacatttaca
ttttgttagaaaatgagataatacattatatagttttttactccttttttcacttaaaata
tatgaagagcattctccaatgtcagtattctgcatttaaaaaaagattacacaaaatgtt
attgtgtaaagtacagatatgcaaaaaaataaaaagcccatagtcccagcatccagaga
taataatcattgtaatattttggtatctgtcatgctagtatgtggatatgtacagggtaa
gtaccttattcctaaaatataaaaaggaaataactttttttcttttcttttttttttttt
gagacagagccttgctctgtcacctacgttggagtgcagtggcaccatcttggctcactg
caacctctgcctctcaggcacaagcaatcctcccacctcagcctcctgagtagctgagac
tacaggtgagccaccacacctggctaattttttgtattttt >IGR1072a
aaagggaaataactttttttcttttcttttttttttttgagacagagccttgctctg
tcacctacgttggagtgcagtggcaccatcttggctcactgcaacctctgcctctcaggc
acaagcaatcctcccacctcagcctcctgagtagctgagactacaggtgagccaccacac
ctggctaattttttgtattttttgtagagaccaggtttcaccatgttgcccaggctggtct
catactcttgggctcaagcaatttgcctgccttggactcctgaagtgctaggattacagg
tgtgagccactgtgcctggctgacatattttatttacttattagtattttttttgagatg
gggtctcactctgacacccaggctgaggagcaatggtgcaaacacggctcactgcagtct
caaaccctgggttcaagtgatcctcccacctcagcttcctgcgtagctgggactacagg
gcaccatcatgcccacacacattggctgatttttaatttttttttgtagagatagggtta
aacctttagacttaccacggttttactaataccagatcaaagaggtgcaagataaatgtt
tgcctttattgcttgtctcttttataaattctctgcattaaaaatataaattccaagta
aaaacaatggaatgaacataaactcccacttcataaccac >IGR1073a
cattggctgatttttaattttttttgtagagatagggttaaacctttagacttaccacg
gttttactaataccagatcaaagaggtgcaagataaatgtttgccttttattgcttgtct
cttttataaattctctgcattaaaaatataaattccaagtaaaaacaatggaatgaacat
aaactcccacttcataaccactcaaaccatagtagcaacaaccttatcctgttgcccagg
ttggtcttgaactcctgtgctcaagtgatcctcttatcttggctcccagtgtgctggaa
tcacaggcatcagccactgcacctggcctattacttaatctaatacatttctgcgccaag
ccccggaagacaaataattacaaataattcccataacaatgataagttcatacattcatt
aagtaaatgtttattgagtgcttactgtgtaggtgctaaacaaaacagcacagtctctgc
cctcttagagatacattctagtgggtaggtagagataatgaacaaacacatgatatatagtatg
ttagaccgtgaaaagtacagtggagagggaaaaaaaagagggcaggtagaatgagtgagt
acactattatatatgggatggtgacgtaaggcatcactgagaaggtgttatttgagcaga
gacctgaaggatgagaggaagtggccatgcagatatttgg >IGR1074a
agtgggtagagataatgaacaaacacatgatatatagtatgttagaccgtgaaaagtaca
gtggagagggaaaaaaaagagggcaggtagaatgagtgagtacactattatatatgggat
ggtgacgtaaggcatcactgagaaggtgttatttgagcagagacctgaaggatgagagga
agtggccatgcagatatttgggggaagaaatttccaagctgaaggcacaagtaagtgcaa
aggccctttccttattttgttcatgctgctgtaacagaacacctaagactgagtaattta
taaataataaaaatttattgcttacagttctggaggtgggaaatccaagatcaaggctc
cagcagaattcgtgtctggtgagggctgctctctgctcccaagatggtgccttcttgctg TABLE 5-continued tgtcctcatgtggtagaagagccaaagggaagaactttctccctcaagccctttttatgag
gtcatgaatcccattcctccatggcctaatcaccttttaagtgccccacttcttaatagc
atcaccttggggattaagttccaatgtatgaattttggagggaaacatacactcaaacca
tagtagcaccaaagcaggaaaatgcccactgtgctgagaattagcaaggaaagccagaag
gagtgaggggaggcatgggagaagatactgtcagagaagt >IGR1075a
catggcctaatcaccttttaagtgccccacttcttaatagcatcaccttggggattaagt
tccaatgtatgaattttggagggaaacatacactcaaaccatagtagcaccaaagcagga
aaatgcccactgtgctgagaattagcaaggaaagccagaaggagtgaggggaggcatggg
agaagatactgtcagagaagtatgtccagagcatatggagacttgtaagccattgagagg
actgaggatttcatgatgagtgacataggagccactggaggttttgagcagaggagtga
catgactcaatttaccttttttctttttttaaaaaaatttgaattaacgttatatttacg
gaaaagatacaaaaatagtacagacagtttccatatcccctccacttacccagcttctcc
caatggtaacacattacataatcatagtgcaatgatcaaaaacagaaaaatgagcatgga
tttattaagtaaactggatcctattctaatctcaccagtgtttccattcacatccttttt
cagtttcaagatcaacccaggatctcacagtgcattgagttaattctctttggtctcctg
cagtctgaatggttcctcagtcttgtctttcataacgcttacattttccaggaatactga
tgagttatgctgtcaaatgttcctcagtttggtcccttg >IGR1076a
cctattctaatctcaccagtgtttccattcacatccttttcagtttcaagatcaaccca
ggatctcacagtgcattgagttaattctctttggtctcctgcagtctgaatggttcctca
gtcttgtctttcataacgcttacattttccaggaatactgatgagttatgctgtcaaatg
ttcctcagtttggtccccttggtgtttctcctaattgcactgaggtctacattttcac
agagatgaagtttgggccttctcactgcatcaggtcacagggttcatgaggtacatgcct
tcttattggtgatgttgaccctgaccacttggttaagatggtttctgtcaggttcttcca
tgataaaattactatctttcccttttagttaatatattgggaaagatagtttgagatta
tataaattttttctcagatttgtgcctactaatattagcttcatcagtgactcttgtctg
aaatgattttttattgtggtatttgcctagtgatgacttttctttttcccttttccttctac
atttattacttgtaattctactataaagaagtgctgtccttgtccctcattttttttaaa
gtaagtacttgtgtatagccacataagttcatgaatatttatttttactctatcggttata
atccaatactgtctttattttgtttctcaaattgttctac >IGR1077a
atttgcctagtgatgacttttctttttcccttccttctacatttattacttgtaattct
actataaagaagtgctgtccttgtccctcattttttttaaagtaagtacttgtgtatagc
cacataagttcatgaatatttatttttactctatcggttataatccaatactgtctttatt
ttgtttctcaaattgttctacccttttgatcattgggagttacttcaggttgggttctgtgt
tctttgaacaaactctaccttttttttaaaaaaaaatattttcttaatttctggcaccac
aaaaaattctagggtcattttgtattttccttgcctcagccctgaagtcaaccacttcac
caaggagccagagttcttttttattgaagagcgtgttttaaaatcgagatcttggaagtag
gtgtcctcattattactggggtgtcatcacactgggccctctttaaataactttgttact
ttcactataagttttcattattttcttagtggttaccctggggattacaaatgaacacct
taatttagatgaatgtcaacttaatttccatttcaaaagttcctatatagctctgttgcc
tctctcttttgtagcattattgtcatataaattatattttttatacattataagcccatca
acagtgttaaaattcttaatgcagttccctttcaatcatg >IGR1078a
attttcttagtggttaccctggggattacaaatgaacaccttaatttagatgaatgtcaa
cttaatttccatttcaaaagttcctatatagctctgttgcctctctcttttgtagcatta
ttgtcatataaattatattttataccattataagcccatcaacagtgttaaaattcttaa
tgcagttccctttcaatcatgtaggaaaagagttacaacccaaaatactttttttttttt
tttgagaccgagttttgctcttgtcaccaaggctggagtgcagtggcgtgatctcagctc
accgcaacctccgcctcctgggttcaagagattctcctgcctcagcctcctgagtagctg
ggattacaggcgcccaccacaacgcctggctgattttttgtattttagtagagacaggg
tttcaccatgttgggcaggctggtctcaaactcctgacctcaggtgatccgcccacctcg
gcctctcaaagtgttgggattacaggcatgagccactgctcccagccccaaaatacatt
tatacttttatattacctatatatttaccttaccagtactctttatttgagtattcatg
agcatttgagtctagtttcatttaccctaaaggattcattctccttttatatttcttgt
agggcaagtctggtgaagacagattatcacaatgtttgtt >IGR1079a
ttacaggcatgagccactgctcccagccccaaaatacatttatacttttatattaccta
tatatttaccttaccagtactctttatttgagtattcatgagcatttgagtctagtttc
attttacccttaaaggattcattctccttttatatttcttgtagggcaagtctggtgaaga
cagattatcacaatgtttgtttatatgggagtgtcttcattcttgttttttgaaggacag
ttttttctggatacagaattcttgattgaggctgggcacagtagcccacaccttaatccca
gcactttgggaggccaaggtgggaggactgcttaagactaggagtttaagaccagcctgg
gcaagacagcaagacccccctgtctcttaaaaaattttttttttttgagtgtggtggcacat
gctggtagtcctatttgagaggctgaggaagagaattgcttgagcccaggagtttgaag
ctacagtgagctatgattgcaccactgcaaaataattcttggttgatagtcttttcat
tcagcactttgaatatgtcatctcactgctttcaggcctgcattgtttcttaagagaagt
cacttcttagctttacttgctcttcgtttgagatctctttttcaacaatttgaccatg
atgcatctaaatgtgaatccctttgagtttaccctacttg >IGR1080a
caccactgcaaaataattcttggttgatagtcttttcattcagcactttgaatatgtc
atctcactgctttcaggcctgcattgtttcttaagagaagtcacttcttagctttacttg TABLE 5-continued cttctttcgtttgagatctcttttttcaacaatttgaccatgatgcatctaaatgtgaatc
cctttgagtttaccctacttggagtttgttcaatttcttggatacgaagattaatgtttt
cataaaatttgggaagttttgggctactatttcttcaaatagtctttctgctcctttctc
tctctctctcttctgggattctcattatgattggtatacttggcattttgtgtacacttga
tagtgtctcaaaggtctctgaagctctcttcattttcttcattcttctgtctattcctc
agactgtataatctcaattgaccggtctttgaactcactgattcttcttctgccagttc
aaatttgctgttgaccccatctagtgaattttattccattactgtatttctcaactc
cagaatatctatttgattctttttaataatgtttgtctccttactgatagtcctgataat
ttggtgaaacatcattctcataatttcctttaattctttagactttgtttctgttagttc
cttgaacatgtttataatagctgatatctaaagtctttgc >IGR1081a
atctagtgaatttttatttccattactgtatttctcaactccagaatatctatttgattc
tttttataatgtttgtctccttactgatagtcctgataatttggtgaaacatcattctc
ataatttcctttaattctttagactttgtttctgttagttccttgaacatgtttataata
gctgatatctaaagtctttgcctagtaagtctaacatctgggcttcctcatagattgttt
ctattgactgttttttaaattgctgtttatggcatgggtcagatgttcctgttctttgtg
tgtcttgttttaaatactctatcaattattgaagtcagattacctactctccagggcttg
cacctgttactatttcttattgttgctgctgttggtttgttctgtgtctttcctggacta
attctgcaaattctatatgctttgtcatgtttggttcctgaagtctctactcagcctagt
gggtaagcgaataattggacagatatttctttctaatgccttgaaccaataaatttcta
gcttttgtcaagtgtgtgcatgtgtgtgtatttgtggagtcatgtcattgatgtgtcagc
agacagtttacaactgcctttatcttcatttctggcatgaattgagtttcaaggtcagtc
agagatgagagcttaggaccctctcaggacatgcatacat >IGR1082a
cagatatttctttctaatgccttgaaccaataaattttctagcttttgtcaagtgtgtgc
atgtgtgtgtatttgtggagtcatgtcattgatgtgtcagcagacagtttacaactgcct
ttatcttcatttctggcatgaattgagtttcaaggtcagtcagagatgagagcttaggac
cctctcaggacatgcatacatccctgcacatgcacatggacttctagattcccaggaata
tgcttgagcttgtcaaagctcccgtggacatcttcttcccagattttccttttaagttt
cttggtcagccttttgttagctccacctggtaacgctgcctcaggcagccacagggttaa
tcagttgccactgattattctgcaggaagggctgttttcagtgagctctgagttaagt
caaataaagataggtcctgaaaatggagcttttcagtgagttgccagacaagacaaatag
aggcagttctctagtagtggagatctgggggacctccaaatctattctgtctcctccagt
ggctactaggttgctgattttcacagatactaagagggctgttggttttcaagttaccat
ggattaagagagaagggcatgggattagggcaacttaaaatgccactttctgctctgaga
ttcagctgttttcctttaataaacacacctcagtttgtcg >IGR1083a
gagatctgggggacctccaaatctattctgtctcctccagtggctactaggttgctgatt
ttcacagatactaagagggctgttggttttcaagttaccatggattaagagagaagggca
tgggattagggcaacttaaaatgccactttctgctctgagattcagctgttttcctttaa
taaacacacctcagtttgtcgctatccattagttaatttccaaagttctgaaaagttga
ttttgacattttgccagtcttattgcttttatgaagaagcagattttggatggctttta
ctccacccttatggaagtagaaatccttagatattaaaattataaatttgtacagatcc
tttggattcaatcaacaccaagggggttctttttatggcctccttcctgatatgcaaaca
ccttttttccaacagtgagaaactcagttcgtattatctacaacacaggtatgtatttgtt
tgactttagtatgtacataaaaatttcgaaattgctaacccacacccctgtgagaaacac
attttcttgagttacttttaaaaagatcactggctgctgtgttgagaactacagggagc
aggcccccaaatcagtgggagcagttacgtggttactcagattattcaggttagagatggc
agtggcttggaccagagcaatgatggtttagatcaggggt >IGR1084a
aaaatttcgaaattgctaacccacacccctgtgagaaacacattttcttgagttactttt
taaaaagatcactggctgctgtgttgagaactacagggagcaggcccccaaatcagtggga
gcagttacgtggttactcagattattcaggttagagatggcagtggcttggaccagagca
atgatggtttagatcagggtccccaaccccgggctgcagaccattacctgtcctcagc
ctgttaggaacagagtcgcacaacaggaggtgagtgacaggtgagggagcattaccgcct
gagctctacctcctatcagattggtggtggcattagattctcacgggagtgcaaactcta
ttgtgaatttgcacgtgagggatctaggttgcgtgctccttatgagaatctgactaatgc
ctgatgatctgagatggaacagtttcatcccgaaaccatccccctcaccccacccgtcca
tggaaaaattgtcttccactaaatcggtctctggtgccaaaatggttggggactgctggt
ttaaatggtgaggcatggtcagattccggatgttttgaaaattgaacccatagtattaaa
ctgacgaattagatataagatgtaagataaagaatcaaggataatgccaattttttgcctg
agcaattggaataatggagttgccattaacagaagagatt >IGR1085a
taaatcggtctctggtgccaaaatggttggggactgctggtttaaatggtgaggcatggt
cagattccggatgttttgaaaattgaacccatagtattaaactgacgaattagatataag
atgtaagataaagaatcaaggataatgccaattttttgcctgagcaattggaataatggag
ttgccattaacagaagagattcaagttctgggagaaagactggttttggtcattttaagt
tttagacgtttattagatattcaagtgcagatagatgcccagttatccacaggcagctga
atatatcagtcaagcatttaggagagatctggattggacacaaacatttatgagttatca
gtgtatagatggtggttgtaggagtggtcagtgccctgcctatccctatgatcctagga
actgccagtgtgctcctgccaactttcagctgctgctgcttttttttttttttttttt
gtcttttagacagggtctcactctgccacccacccaggctggggtgcagtggcacaaat TABLE 5-continued cacagctcactgcagccttgaaccctcagactccagggatcctatctcagccaagtagct
gagactacaggtgtgcaccaccatgccttgctaattttttaaaaattttatgtaaagatg
ggatgtcactatgttgctcagactttcttttaaactgtg >IGR1086a
cactctgccacccacccaggctggggtgcagtggcacaaatcacagctcactgcagcctt
gaaccctcagactccagggatcctatctcagccaagtagctgagactacaggtgtgcacc
accatgccttgctaattttttaaaaattttatgtaaagatgggatgtcactatgttgctc
agactttcttttaaactgtgaaagcagctgtgtcggtacacatggcaagccagtaact
aacatgtgctagaatagccttcactcagtaaccctggcaagttgttatataaatactcca
ggtctcttgcccttaggtgggataattctgaggtatatattttgccaaactccccagag
tctccctggggcaccaaactctaattgcccacttaccgtagctggcttaatagtaaactt
ttcattggctgctttctctttcatacacaatttccccaatttcctactgattacttcac
gtgaagcattgttttacgctctgcttctgggagaacccaaactaagataatttaaagcta
tgagactggatgagatcaccaaataagtgagcacagagaagaaaagaggtgcagactctg
agtactaaaacctgtgacattgaggggccagggaaatgaggaggaaacagcaaaggaaac
gggatgtgcaggtgttgcagggaggaggcagagctggatt >IGR1087a
tctgcttctgggagaacccaaactaagataatttaaagctatgagactggatgagatcac
caaataagtgagcacagagaagaaaagaggtgcagactctgagtactaaaacctgtgaca
ttgaggggccagggaaatgaggaggaaacagcaaaggaaacgggatgtgcaggtgttgca
gggaggaggcagagctggattccagtagggctgggattgtcgggacagtttgagtacaa
tgcagtggagggtgacataatgatgagccatggaatttaagttgaataaggagagaagta
caggcatcagggaaacaacctgtgaaaaagccatagaatcaatggattgaaatctcagtg
gggtcaaagaattgctgggggttgaggaccacaggaaaattgtagacaccatgggttatt
ggagagtgagatgcttaaaactgagattttggaggggtgcagttattgttattaaaagga
cggggctctagaataagaccatagaactgagtatcttctcactggaggaaacaaaaaggg
gctgagggaggccaaggtaggcagatcacttgaggccagacgttcaagaccagcctggcc
aacaaggcgaaaccctgtctctactaaaatacaaaaattagcctggtgtggtggtacatg
cctgtaatcctagctacttgggaggctgaggcaggaggat >IGR1088a
catagaactgagtatcttctcactggaggaaacaaaaaggggctgagggaggccaaggta
ggcagatcacttgaggccagacgttcaagaccagcctggccaacaaggcgaaaccctgtc
tctactaaaatacaaaaattagcctggtgtggtggtacatgcctgtaatcctagctactt
gggaggctgaggcaggaggattgcttgtatcagggaggcagaggttgcagtgagctgaga
tggtgccattgcactccagcctgggtgacagagcaagactccacctcaaaaaataaaaaa
gactgagaggccaaggagttgtattagaccatcacttggatattgaaatcagcaatgatt
attagtaatgggtgacactgaaccgggagctaaactcttcaacaataagagggagtga
ccaagctgggaatgaaagataactgcaacaagagtgaaatgaagcagctttttcttgaa
cacttacacagtatttagtaggtggcaagcagttctaagcagtttgtaaataatgtcatt
caatcttcataacaaccctacaaaatatgtaccatttttacccacttttacatataaggaa
acagaaaacaggacaaataacttgctcaaggtccccagctagtgagtggtgtgctaggat
ttgagcccaggcagtctggctcattctaacctccatccat >IGR1089a
aggtggcaagcagttctaagcagtttgtaaataatgtcattcaatcttcataacaaccct
acaaaatatgtaccatttttacccacttttacatataaggaaacagaaaacaggacaaata
acttgctcaaggtccccagctagtgagtggtgtgctaggatttgagcccaggcagtctgg
ctcattctaacctccatccatgctgtgatggctattcattccaatgtggggaagggggat
atttggagactgatctagaagcagcaatgagaagccagaaaggcacctatcccacctcca
aacccatgggcttcttggaatgaaagcagccactctcagaagtgctgccaaggatgccac
atattcaggggaaaccagatttaaaattgggaagtctgttttaacttgcaaatgatact
tttgtttcactgcctatattgatcgtgtattgcctttgttattctttgctgcaacaacta
gcactttcattaacatgttgatagaagtaactggctttaatatttactgagaaatgttt
tattttgcagttaagatgactgtttaattttgatttagcaacagataacattaagaaaat
attatttgcaaaactgtgagtttgctaaagctaggagatgttgaattttatcaaatatag
ctgctagantttttcagaattttttcaccttcggtttt >IGR1090a
gatagaaggtaactggctttaatatttactgagaaatgttttattttgcagttaagatga
ctgtttaattttgatttagcaacagataacattaagaaaatattatttgcaaaactgtga
gtttgctaaagctaggagatgttgaattttatcaaatatagctgctagantttttcaga
attttttcaccttcggttttattatagtgatggatttatcaacagattttcatttct
gaaatcttgcattcttgggataaaaatatcttggttattgtggatgtttaatatatgact
agaattgatttgctcttaatcttactcgtgattacatttaggaccccccccccaccccacc
accaccccaggatactctgtcttaaggtccttagctttaatcacatctgcaaagtttcc
tttgctgtataaagtaacagtcacgggttctagaaatcaggacctgtctatctttggggg
ccaaccatttaacctagcacagatagatgccttaggaccttagggcttaattctcttctg
gacccagttgagaaagctgtctaggcaaacatgctcattatagctacagatggcacaaa
accatgccatgtgactgaatcaagacccggtatggtcctggctgactctgaatgacaaaa
ctctacaaagcataattcaaaagcgtgtgacttggttgca >IGR1091a
cagatagatgccttaggaccttagggcttaattctcttctggacccagttgagaaaagct
gtctaggcaaacatgctcattatagctacagatggcacaaaaccatgccatgtgactgaa
tcaagacccggtatggtcctggctgactctgaatgacaaaactctacaaagcataattca
aaagcgtgtgacttggttgcattctgtgtggaatggaaggattcaagatgtcagctggca TABLE 5-continued attccaggaaaaactgtgattaggcttttcttagaagtggcatctgaagagcaaatggag
aggcctgttcttccaggtctggttggaccctacagggagcaggccttgactctgtgagtg
agcctggcttgccttccacatggcaatgcccacttagagaggaatcaggattgatggtga
agccagtatgctacacaggatagacgcagaggagtgttacaggcttcttcacgatgggca
gatcaggcctcaagtggtcagagctttccaaaggtgggtgtgcacagtggagaatttcct
ctctgtagagagagctctgagtctggatgaccatctggaagggatatgtaggagaagaag
gtggtgggtactgacttagatgattacttaaggttcctgtcaaactttgagaccccattc
aactacttcaaattttagttggggaaaccaagtcccagag >IGR1092a
agagctttccaaaggtgggtgtgcacagtggagaatttcctctctgtagagagagctctg
agtctggatgaccatctggaagggatatgtaggagaagaaggtggtgggtactgacttag
atgattacttaaggttcctgtcaaactttgagacccattcaactacttcaaattttagt
tggggaaaccaagtcccagagagagaggtcactggatttataaagttaaaagcagagcca
aacatacatctcaccatttctggtcatcctcagatattaatactcagttttcaaaccac
atgcaaggaagtaaattcagaggtaacatttaactatgatttaaaaaaataccaaaacca
taaattttcaaggcagtaattatctccttctcaacagtgctttgagaagaagcatgcatt
tgcactgggagggaggcacagagtcgagtctcggctgtactgctgaaccctgaaggcct
gacagaggctgcctggaatgggatgaagagcagcaaatcagaaacaggcaatctgtccaa
ttttcagtgaaacaagtttcatgattttagaacctctcaacatccaaaatcctagacaca
atgttcctttgaaagaatatattttcttattgactaagttgatatgagaaataagtttct
tattacactttctgaggacctacatttctatggcattt >IGR1093a
gggatgaagagcagcaaatcagaaacaggcaatctgtccaattttcagtgaaacaagttt
catgattttagaacctctcaacatccaaaatcctagacacaatgttcctttgaaagaata
tattttcttattgactaagttgatatgagaaataagtttcttattatacactttctgagg
acctacatttctatggcatttaaatcttggatattttaatgaacattgaatcccaggga
gctaacactgcatttcacaatctctgagcactgatcgatgttcttttaatcctgtagaa
tttctccacatattcagaacgtcctaaaagctccacaaaatcttcatcatgagtgattac
cagaagctggaagttacgctgctgtgagcgactttttattatcctgcaacaatatattca
gaacatattattagtaaagagcataaccccttctttgatttgaaaagtcaccgcaaacct
tgtcagacacatgaacttgtgctgtgtcagggcccagctaccctgcaggaagtggag
gggtggccccaggccttcaggccagccaggcaggagtctcttctcctctccagacagtag
ggacacatggcctgactcctcacttaggtctggcttagggactcacaggaatacaagaac
tagtttcttccagatcagaagttctcactaaagcaggtat >IGR1094a
tgctgtgtgtcagggccccagctaccctgcaggaagtggaggggtggccccaggccttca
ggccagccaggcaggagtctcttctcctctccagacagtagggacacatggcctgactcc
tcacttaggtctggcttagggactcacaggaatacaagaactagtttcttccagatcaga
agttctcactaaagcaggtataaatattttattgagttttcttaatatccaaactgttc
aactatagaaggcttactccttcgcctgggattttcctgacctgttactacttttctctg
gaagaaaaatttaaaagtaataaagacaaactacaggtaaggggaataacactgctttct
taagagctgggtctacttagaattctgccaccaccagtcactagatgcatcattactatg
acacacagggacctgagtgggtgttctgggaacattttgctgaggtaaccagcaatgtga
ctgaaacctgaaagactttttcttttagctagccacttatcccccttcctggagctggatg
catttgaggtttcaaaagcactcgcccttacttgtgatgatggctgcagaaaggtggccc
tgcgctgctgagctctccttctggccctctctgccagaaagggactgtctggagccagga
gtgcctgaaacacctcctttgacctcagggaaactgcctt >IGR1095a
ttcttttagctagccacttatcccccttcctggagctggatgcatttgaggtttcaaaagc
actcgcccttacttgtgatgatggctgcagaaaggtggccctgctgagctctcct
tctggccctctctgccagaaagggactgtctggagccaggagtgcctgaaacacctcctt
tgacctcagggaaactgcctttttctctgccagcatagtccttatgcaagagctgcttga
caaccttggcgtctacactgaccccaggtgaatgtggtaaaaggtgtgcaatttttaccct
cactggactttacctaatctcaaataagcttttttgagtaagagctctgtcattcctcaca
gttctctgacacatgtggaaagctggggagacagtcctaaacccactaccactacctgca
gatgtcttagcagggcatgctaattgctgtgcatgacatgtgggttcctctggtaggttt
acaggaaaaccaggccaggaaccctcacagtgactctctccctgtgaacacacttgggg
agctgcaggatgtgtctgggctgctgttcaccatctagttcctttaggagggatctgaa
gaattactatcaaaaggtaaagcccagggcctggcaccaactggcttccccaagaagtgg
ggaacacagctagagaacgttttcatcacagaactctctt >IGR1096a
aacccctcacagtgactctctccctgtgaacacacttggggagctgcaggatgtgtctgg
ggctgctgttcaccatctagttcctttaggagggatctgaagaattactatcaaaaggta
aagcccagggcctggcaccaactggcttccccaagaagtggggaacacagctagagaacg
ttttcatcacagaactctcttggttttgaagaactatcacaacctgtccccaaatgtgag
atacttactcaaccagagcatgtgcaagagatacttactcaaccagagcatgtgcaagag
attcaatgttttctcggtcaagatttgttgttggctcatccaaggcaatgatgccacagt
tgaggcagaacgtttcagcagggccaggcgaatgatgagtgaggctaatacctggaaaa
aagcccctatgtgagaagcccagcacagaccttctcatctcatggcaggcaagcagtcct
gacatgatcttttcagcagggaaaagtgggaaacgtcacaggttcactgttaggtaaagc
actgccctctgggagagcccagcactgggaccagattcttatgtcctccagaaggagaac
ctgcatgatctcagcctatcattcaccacaaaacaaaatgctcagaacaacgctgatgct
ctcacataaaaaattacatcagctacaaccaacttgagac TABLE 5-continued >IGR1097a
ggaaaagtgggaaacgtcacaggttcactgttaggtaaagcactgccctctgggagagcc
cagcactgggaccagattcttatgtcctcagaaggagaacctgcatgatctcagcctat
cattcaccacaaaacaaaatgctcagaacaacgctgatgctctcacataaaaaattacat
cagctacaaccaacttgagaccaaaggctagaaacagagacaatgccatttatctgtaat
tttaataatcctgtaagatgagcaaccttaaaaattcttgacctggctatttgcctgata
atgggatctgttagaaaacttcgacacgttttctagagcctctcacttttctctgctac
ctttaaatttccatattcttgtgtataatcctgagactgagagaataaaaaagaaaatcc
taggtcaaagtatcaggagtatagaaatgtggtttcagttaagcttacctgtagaaaatc
caagtaactggaactgttaggcattttcgtggttactagaaacctaatactaaaaccctc
agacccactgaaaccatctgaggatacaagacacacagaattgagagagtagggctattc
taggaagtataaactactctggtgtgagctgtaagtccccttcccctcagtttgtggg
tgggtgcgcacacatcagtgagttggtaattttagaatag >IGR1098a
ggcattttcgtggttactagaaacctaatactaaaaccctcagacccactgaaaccatct
gaggatacaagacacacagaattgagagagtagggctattctaggaagtataaactactc
tggtgtgagctgtaagtccccttcccctcagtttgtgggtgggtgcgcacacatcagt
gagttggtaattttagaatagtttatgtcttttcttaatgcctaggcaagccagaagac
agggccacagcttggccctgtgagggacaggcattccttcctgtctttgaatccaaact
gctgtcaactctaccaccacccactcacatgcagagcccctggctggctgctagagcctc
agcaaaagccagtgttaggtaggctggaggcccacctccattatttgttctctcccctca
caccaaggagacaattattgctaattaattttcataactcagaatagctacaaaaaatct
ttttcctcaagatattttgaaagtattttaattcaaagagaccatgtttcaaactctg
tattttctcatttataattaccactaaaaatcatcaaagcacgtagggatactgattaca
gatcacaagtttgtcattttgtagactatgatttagacagtaatctgcagatgctttaa
attgggatcagctgtctaggctgacaacataatacatata >IGR1099a
gaaagtattttaattcaaagagaccatgtttcaaactctgtattttctcatttataatt
accactaaaaatcatcaaagcacgtagggatactgattacagatcacaagtttgtcattt
tgtagactatgatttagacagtaatctgcagatgctttaaattgggatcagctgtctag
gctgacaacataatacatatatgcatggcatgttctttttttttttttttttttgagacgg
agtttcgctcttgttgcctgggctggagtgcaatggcacgatctcggctcactgcaacct
ccgcctcccaggttcaagcaattctcctgcctcagcctcccgagtagctgggattacagg
cacatgctaccatgcccagctaattttgtatttttaatagagacggagtttcaccatgt
taggctggtctcgaactcctgacctcaggtgatctgcccgcctcggccttccaaagtgct
gcgattacaggtgtgagacaccatgcccagctgcatggcatgttctttaagcaaaaactg
caaactatgaaaatgagttagataatgtaagcatctatttctatgattttagaatttat
ttaaaaaagtcaagggcctagaggtgttatcaagtgtaatcttctgccttgatctgaaa
gcagaaagctcaagtatctgtgacatctttgttacaaacc >IGR1100a
accatgcccagctgcatggcatgttctttaagcaaaaactgcaaactatgaaaatgagtt
agataatgtaagcatctatttctatgattttagaattttatttaaaaaaagtcaagggcc
tagaggtgttatcaagtgtaatcttctgccttgatctgaaagcagaaagctcaagtatct
gtgacatctttgttacaaacctgtgcacagtgaaggatccagccttgttccccaaggatg
ccatattcctgattctttaaaacttcattcctcttcctgatttccaatgtaggctgtcct
cacagagccttacctgaagccagatggcctgacccagcagctaagtctttgtgtatgctg
tggtagggacttagttctatgaggggctactttcttaatgagactccttactatactgga
atattcattctagcttaagctagaatctggtttgcaatactattatgtcattgattctga
aacatccttatggttataattgcattttttcattcctgctggcacataaaatagtggtatg
tcttataactgatgagacagtgaccttattctgataaggagtgccatgaaaactctaacg
ggtcttcagcttcttgttctacatttagcctatcctgtgagaatgcttcaggcccttctt
ttaaaagtctacataatgttgcaggaaatgttggttagct >IGR1101a
tgcattttttcattcctgctggcacataaaatagtggtatgtcttataactgatgagaca
gtgaccttattctgataaggagtgccatgaaaactctaacgggtcttcagcttcttgttc
tacatttagcctatcctgtgagaatgcttcaggcccttcttttaaaagtctacataatgt
tgcaggaaatgttggttagcttcaggagagtgtaataatagtagctgagcctgattcatt
ttatatagcagcaaagagcttcccaccattcaggtgtagccttgggtgcttccactgcac
tgatgtttgtttctctctttcagttacttgggtgagttggctccccaggcttttgagata
cctgcctttttgtccagcactgcatcgtcctcgcatatccaaggctgtgtctcccttcagc
atcaccactcggtagttataattccgccttttatcagaagctgatacattttcatcggca
tcagaccgtatttctatgtattcaatatctgacacaggaagaagaatattttagaggaac
ctatgctctgtagccttttgtcatttacaaacatatcaagtaagcctaggaacaacagat
gaggctgacattaccagaggaaaacaatggctggtgtgggaaactctttctctggctggga
ggattcaagagcctggtggtctggccagaagcaacccaga >IGR1102a
attcaatatctgacacaggaagaagaatattttagaggaacctatgctctgtagccttt
gtcatttacaaacatatcaagtaagcctaggaacaacagatgaggctgacattaccagag
gaaaacaatggctggtgtgggaaactctttctctggctgggaggattcaagagcctggtgg
tctggccagaagcaacccagatgccccagttcctcagcctcaactctttcttagtttccc
tgttaagagtttcctccaggccaggcgcggtggctcacgcctgtaaacccaacactggga
ggccaaggtgggcagatcacctgagggcaggagtttgagaccagcctggccaacatggtg
aaaccccatctctactaagaatacaaaaaattagccaggtgtgggagcgcgcacctgtaa
ttccagctactactcgggaggctgaggtgggagaatcacctgaacccaggaggtggaggt TABLE 5-continued tgcagtgagccaagattgcaccactgcgctccagcccgggtgacagagaagtgcgagact
ccatctggaaaaaaaaaagaaaaagaaaaaaaaaagagtttcctctggatggtttttc
ttattgcattttggcttatccctatctacactatgacagaacctattatgtcatcagcta
aatataatgcctactgcagtcaaatatgtaagtcctgtta >IGR1103a
accactgcgctccagcccgggtgacagagaagtgcgagactccatctggaaaaaaaaaa
agaaaaagaaaaaaaaaagagtttcctctggatggtttttcttattgcattttggcttat
ccctatctacactatgacagaacctattatgtcatcagctaaatataatgcctactgcag
tcaaatatgtaagtcctgttaggctctggaacagaaaactttacattttcttgctacaag
atgttgccaagataagaattcttagaaaatctcaaagacatgcttagaaaggggtccagg
gaggtaatgctggcatgatgagaggtcataagggggaagagctgcggagagggctttggaa
agagcatttgtgatacaccatggtactcaccttgtccacgataggtacttcgccacaggt
cacgtataattttattgatttcttccatttcatactgtgaaatttcattattgctctgg
aaaaggaagtcattggtacttcatatatataaaaaataattatgtgtaatagtaatatta
aaatacataaaatatataatatataaaaaatagaaatataaataacttcctcaatatttt
caatggtaaaagtagaatatagtaagagctacaaaaataaacagcagcaaaactttgctg
cttggctaatactgaaaattggcaggcttatttctagtgc >IGR1104a
ttcatatatataaaaaataattatgtgtaatagtaatattaaaatacataaaatatataa
tatataaaaaatagaaatataaataacttcctcaatattttcaatggtaaaagtagaata
tagtaagagctacaaaaataaacagcagcaaaactttgctgcttggctaatactgaaaat
tggcaggcttatttctagtgctccaggggtacccttctccatattcactctctaggatac
aacaaatactccttacgtaaatacttaaatactgtgaaaacttcaggaaacataattt
ttagactttttttcttaggccgtggtaacttattggagggaatgcttccactgatactcac
gggtcacaggaaggcctgctgaatggacgacagggagttaaagggtagaaggtttacggt
tagccaaggggcctgcagtctatggggaaaataggagaatcgaactgccaccttgtccct
cttctatcactgttaaggcttaccaaaagtcagcttcttatgttggttttattcctcaga
tcttagattttttaccaactggaagctttggttcagcgagaatgatttagaagcttaagct
gaactgacatcaaaattttattttacctttccttcacagattcagaaatcctaattctaa
atattaacttccatatttatattccaaatcctaactctaa >IGR1105a
ttaccaaaagtcagcttcttatgttggttttattcctcagatcttagattttttaccaact
ggaagctttggttcagcgagaatgatttagaagcttaagctgaactgacatcaaaattttt
attttacctttccttcacagattcagaaatcctaattctaaatattaacttccatatttta
tattccaaatcctaactctaagcactaaattccacttagtccagacatgtccctgtcctc
aactctcttttaaggtagtagtttctaaacactaaaaacaaagaggagaaatgtttgtaa
aagcaaaagtagcctgtcaaaacctaacattgttcccaccacagtcacctttcatcaaaa
agcccttaggttcttttggaagcgggtttatgaactaataaatgttgcaccagtggtaaaa
aggcaaacattactgcgatcatcataacaaaggatgtgaggatgtgaggcgacttacttcc
atttgcaggcctcttatctgatgcatacaaaaaaagaaactgaatataatgctactgcct
ctgtagaatcatttcgtgatcttctggttcaccagcaagagagaaagaaatgactcaaca
taaatacattttaaatatcagatgaaggactgtgaagtagtagaagactggaaaaaacca
tattctgcttgttgatgagaatgcaacaagtctccatttt >IGR1106a
gatgcatacaaaaaaagaaactgaatataatgctactgcctctgtagaatcatttcgtga
tcttctggttcaccagcaagagagaaagaaatgactcaacataaatacattttaaatatc
agatgaaggactgtgaagtagtagaagactggaaaaaaccatattctgcttgttgatgag
aatgcaacaagtctccatttctaccttatacatttatctcagcctaacattttatgctc
ctttcaaaaggagacaaaacatctaagtatttcctaaaaacaaaacaaaactgatggaat
gttagaccaatcatgtaaagactgccttttccatagcttatatatcatgatcctgattttt
caaatgacattaaaaaaagttatctttccattcaagttaaaaatcttcaaaaactaaca
taagcattctaatgtggagaacaagctccagacaaggcaggggtggccaaggcgcacacg
tgcagtctgccttggctccttatacaacacaggtggtgcatcctgtcccatggccaggt
ctgctgagacacagcactgcgggaaaaagatctagttcagggagaggtctcaacccacca
aagagtgtgtcggatggagttgatgactaccactgtgggacggaccattaactcatcttc
gtatcctctgtctactatggaatttacagctgtactgt >IGR1107a
cttatacaacacaggtggtgcatcctgtcccatggccaggtctgctgagacacagcactg
cgggaaaaagatctagttcagggagaggtctcaacccaccaaagagtgtgtcggatggag
ttgatgactaccactgtgggacggaccattaactcatcttcgtatcctctgtctacta
tggaatttacagctgtactgtgtaagagatggggatgactaagtgcgctacagtaatcta
cataagggaataacaatgataataatgattattattgatgaccatttaccatatgcgaga
caaaactatgctaaataatcaatttcatttaatccttacgacaatactgggaattagata
ctgttatctctatttaccattaacaaaactaagattcaatgaaatcagtgacttgttcaa
gatcagagaaagtggctaggatattaacagcccttgaatatgacagtttaaaattgaaaa
ggcagtcaaaattccatcttttaaagccaccagactcagttttatgagggaatgttatca
aatcttcaagacacacctagctcccaagtatataaggtatgacacagcaaggagaaacat
aagggggaaaaaagtacaaggctattttttcttatgaatataaacattctaaataaaacgaa
atttagtagtaagggtagtaaaaagaatatatcatgacca >IGR1108a
tttaaagccaccagactcagttttatgagggaatgttatcaaatcttcaagacacaccta
gctcccaagtatataaggtatgacacagcaaggagaaacataaggggaaaaaagtacaag
gctatttttcttatgaatataaacattctaaataaaacgaaatttagtagtaagggtagt TABLE 5-continued aaaaagaatatatcatgaccaagtagtgtttacaacaagaaagaaacagtaaaactgggg
aaaataattcaactaatatagtagcagattaaaaagaaaaaaataattttttcaatagatg
tcataaaaacatttgatacactgtaacactgaattttgataaaatatcttaagtgaaaaa
tcaaagaatgttttcttaactggacaaaatgactccctcagatatccacagcaagcatca
aatttaatttaaaatctatagaagtgttcctcctaaaactaagaagagaaagatgcctcc
tattatggctgctctaaaataaggtcctggaaatccctaacgattcagggatttcacgat
tcaaatccctacctaaaaagaaatgagaaatgaaaaaaagagagaaaagcctgtcattat
ttttgcaggtgacagaattgtatgcttagaaaatccaagaaaatcaactgaaaaattatt
cagactaatgagatagccagagataaatatataaaaatga >IGR1109a
taaggtcctggaaatccctaacgattcagggatttcacgattcaaatccctacctaaaaa
gaaatgagaaatgaaaaaaagagagaaaagcctgtcattattttttgcaggtgacagaatt
gtatgcttagaaaatccaagaaaatcaactgaaaaattattcagactaatgagatagcca
gagataaatatataaaaatgaagttttattatctagaggcaaacaccaataggaaaggca
atagaaaaaaaaaggatcctattcacagtggcgataaaaaccctaaaatgcctaggaata
agtctaacaaaagggtataggagctagaggaaaaagctgtaaaacttttacaataggataa
aaggaaatgattgagcaggagatgcatactaaggagtccagaatggtagatgtgatatta
caaagatgtccgttctcctcaaataatccataaattaaatgcaatccaaacagaaacccc
aataaaattaaaaaatgcttaacagaatccataagctgactctaaagttcatatagaaga
gataatacaaaagaaaaaaaataaattttaaaagttggtatacaaaggaaaatccagaaa
caaacccaaatgcatatagaacgttagtttataactgcaacagttcaaatcaactggaaa
gttttcaacagtgttacaaaagataaaaaaaaaattatta >IGR1110a
taacagaatccataagctgactctaaagttcatatagaagagataatacaaaagaaaaaa
aataaattttaaaagttggtatacaaaggaaaatccagaaacaaacccaaatgcatatag
aacgttagtttataactgcaacagttcaaatcaactggaaagttttcaacagtgttacaa
aagataaaaaaaaaattatacccgttatccaacctcaaaataaaatccaaatgaatgaa
aggattaaaagctaaagtatttgggcagctgaggtgggaggattgcttgagcctggagtt
tgagaccagcctgggcaacatagtgagatcccatctctacaaaaaaatttaaaaattagc
tgggtgtggtggtgagtgcctgtagtcccagctacttgggaggctgaggtgagaggatca
actgagcccgggaagttgaagctacagtaagctgtgatcatgccactgcactccagcctc
ggtgacagagtaagaccctgtctgaaaaaacaaaaaacaaaaaacaaaagctaaggtaaa
ataaaacaatcagatgaaaacattttgataatttttaggattgggaagccttttctaaataa
ggaacaaattgagaagccataaatcaaaagactaaagatttgactacctaaaaattaaa
agttacaaaagataccataaagaaagctgaggcagctggg >IGR1111a
gtctgaaaaaacaaaaaacaaaaaacaaaagctaaggtaaaataaaacaatcagatgaaa
acattttgataatttttaggattgggaagccttttctaaataaggaacaaaattgagaagcc
ataaatcaaaagactaaagatttgactacctaaaaattaaaagttacaaaagataccata
aagaaagctgaggcagctggtgcggtggctcacacctgtaatcccaacactttaggagg
ccaaggcaggcagatcacttgaggtcaggagtttgagaccagcctgaccaacatggtgta
aaccctgtctctactaaagatacaagaattagccaggcgtggtggtacatgcctgtagtcc
cagctactcgggaggctgaggcaggagaatccgcttcaacccgggagatggaggcggaagg
aagtaagctgagattgtgccactgcactccagcctggacgacagagctagactctgtctc
aaaaaaaaaaaaaaaaagaaaaaacgaaagaaaattgatggacaaacgataaactgg
gaataggtacttgcaatgtatgtgaaataattaacatctagaatctattaaaatgtgac
aaatcaagaaacagacaacctagtagaaaaactggcaaagagatatgaataggtaattct
tggagaagaaatacaaatagacaacatacaaaaagacatt >IGR1112a
agaaaaaacgaaagaaaattgatggacaaacgataaactgggaataggtacttgcaatgt
atgtgaaataattaacatctagaatctattaaaatgtgacaaatcaagaaacagacaac
ctagtagaaaaactggcaaagagatatgaataggtaattcttggagaagaaatacaaata
gacaacatacaaaaagacatttaacttcactagtaaagagggaaatgtaaattaaagtgc
aagcttttttttgtgcagccaataaaatgtcagtaacaaaatccagacatggaatgggcac
tttcatatactattggtggaaattttctaagtgtttttagaaggcaatttggcattaact
aaaaaatatacataacatctgagccagtaactccatttctaggaagctgtcttttttgaca
tatctgcttagtgtgcaaagacacactctgcagcattatctgtagtagcacatatttaa
aagcttttctaatatgttcaatagtggttaaataaagtagatatcatgcattttacagaat
atgcagccattaaaaatacaaggtacttgaatatatgaacgtaaaagattatcaccacgt
taaatgaaaaaaaaactcagaaaaatatctaccttgtgataatgcttacaaagaacaaa
aaagatgtatttgggtgtactatgtgcaaagccattgtga >IGR1113a
atagtggttaaataaagtagatatcatgcattttacagaatatgcagccattaaaaatac
aaggtacttgaatatatgaacgtaaaagattatcaccacgttaaatggaaaaaaaactc
agaaaaatatctaccttgtgataatgcttacaaagaacaaaaaagatgtatttgggtgta
ctatgtgcaaagccattgtgagggaaatgaaaatatgtcaccaacttaataattcttaag
ggctgaatcaaagttagacactgtcatggaaatgagcctaagtctaccttgaagtgtgtt
ctgtggtttgcagttatggagcgtggggaagcccaaatatctgtaatacaaggctgaatg
gctttagttgtataagtggtacaaaatattattaagtacaaaggtaggaaaaaaatcaca
tatgtttgggaagggcttaatcaacataacattccaaggatgggagagatagcacaggaa
aatatgggacaaaattgtttggttagaacacacttggtagtaggaattgaaatgggaaag
cccaggtatggaagtcattcctaaaattagaagggaataggggaccaccagctttaggaaa
atgaagctggcagaagtataatgggtggaggtgggggtaggaaggacggtaagagataag
aggtgggaaaggtgccacggtaataggtgagagttactta TABLE 5-continued >IGR1114a
tggttagaacacacttggtagtaggaattgaaatgggaaagcccaggtatggaagtcatt
cctaaaattagaagggaatagggaccaccagctttaggaaaatgaagctggcagaagtat
aatgggtggaggtgggggtaggaaggacggtaagagataagaggtgggaaaggtgccacg
gtaataggtgagagttacttaggctgaagccatgaaagaaggcagctctgggctgggtg
cggtggctcacacctgcaatcccagcactttgggaagctaaggtggggaggatagcttgat
cccaggaagtcaaggctgcagtgagctgtgatcatagcactgcactccagcctgggtgac
agagtgagatcctgtacaagaaccctataggagctattgagtgacatatagtgggcccaat
taacttaacacgcttttatcacttggactttacaggcatttaacatcaaataacttacag
aatgaccttgaaagtccatgactgtctggtgaggcaaagatttgaatttcatgggctgca
aactgttatggtcaagtagccatctggctagtgtatcagctccaccacctgcctggagta
tgcacatctctcagttaaatgcatatactaactcatgcgaagtagtatgatttctttgtg
aaaactggctcttaaagtgagaggccaggtgaggtggctc >IGR1115a
gactgtctggtgaggcaaagatttgaatttcatgggctgcaaactgttatggtcaagtag
ccatctggctagtgtatcagctccaccacctgcctggagtatgcacatctctcagttaaa
tgcatatactaactcatgcgaagtagtatgatttctttgtgaaaactggctcttaaagtg
agaggccaggtgaggtggctcacgcctgtaatcccagcactttgggaggccaaggtgggt
aaatcacttgaggtcagatgttagagaccaccctggccaacatggtaaaactctatctct
actaaaaatacaaaaattagccggtgtggtggtgggcacctgtaatcccagctatttggg
aggctgaggcaggaggatcgcttgaacctgggaggtggaggttacagtgagccgagtttg
caagaatgaactccagcctgggtgacagagccagactctgtcttaaaaaaaaaaaaaaa
aaaagtgagactctctcggagctcagaaaataatgatttataaattactttagtctgata
tttaaatactcattaagagtctgaaagatttcattaaaaatttcagtaacaatcgattgc
attttatgaggaaaaatgatggctttaatggcatttatatttctggtaatccatgaaagt
cttaacaagcttgtccagcctgccttattttgttgttctg >IGR1116a
agctcagaaaataatgatttataaattactttagtctgatatttaaatactcattaagag
tctgaaagatttcattaaaaatttcagtaacaatcgattgcattttatgaggaaaaatga
tggctttaatggcatttatatttctggtaatccatgaaagtcttaacaagcttgtccagc
ctgccttattttgttgttctgttttgttctaggcttttagcagactgaagccatggtttt
tagttttgtctctagtgatgagcagaaaagagggatgaggaagaggcttactggtccaa
ccagaaagagaagctaagaacccatgactggattctctcccttggacaccccacagacca
atatctcaccttccaggagaagacccttccagctcttgcttctttaaacctattaactta
gttttctttagctagactcccaaacatcagcttttacaattcagcctatggttcaatcac
tatggcaagataaacatttgtttaggtgtgaaacaccactggctatctttgggttttgta
atctaccctcttgaggttgcaggagctactgtgaaaccttactgcatccatggtcatgat
agagatggtgactctaaggtgagccctgaataaagccctcatctgaagctcccctcgaat
gcagggacccaggctctgaagagcctcacagaaagctggc >IGR1117a
gtttaggtgtgaaacaccactggctatctttgggttttgtaatctaccctcttgaggttg
caggagctactgtgaaaccttactgcatccatggtcatgatagagatggtgactctaagg
tgagccctgaataaagccctcatctgaagctcccctcgaatgcagggacccaggctctga
agagcctcacagaaagctggctaccttggatgcaaaactgtaaaggttacgtgtttacaa
tgagtcttaaaagaagcatgacctggccaggtgcgtggctcatgcttgtaatcccagcac
tttgggaggccaaggcaggtggatcacaaggtcaagagatcaagaccatcctggccaaca
tggtgaaaccccgtctctactaaaaatacaaaaaattagccgggtgtggtggcaggcgcc
tgtaatcccagctacttgggaggccgaggcagaagaattgcttgaacccgggaggtggag
atggcagtgagctgagatcgcaccattggagtccagcctgggcaaaaagagcgaaactct
gtctcaaaaaaaaaaaaaaagtattacctaatatgcaaccttccacatctggggaaaaa
tgagagtagaacattttgggcatggggtagaacaccatatcttgagtgatatattctaac
atcatttaaattggtatattgtattagtatggggtaatac >IGR1118a
gcaccattggagtccagcctgggcaaaaagagcgaaactctgtctcaaaaaaaaaaaaaa
aagtattacctaatatgcaaccttccacatctggggaaaaatgagagtagaacattttgg
gcatggggtagaacaccatatcttgagtgatatattctaacatcatttaaattggtatat
tgtattagtatggggtaatacattccaaatgatgataatttccccctttttcatctatgt
gtctctgaccactgccaatgcttatacttagtgatgtttttagatgattactaataacag
atggtaatcagcttttcttgaaaatgcactgctgacttcctgtgttaccttaaatagaca
gctgaacgcaacaattacactgactgcatgctttattctaagacgtgaaagaatgaggga
aattttgtaccttactttcttctgggtgagaaggcaaatttagggctcaggctcaccgtataaatc
ttgagaaggccactgtttgcgagcataagccacaaagactcaattttggggaaatttgta
tcacctcttttcatttagaagaatccatctgagtaccaggtaagagaactcagtaaacag
cctggctttgttccttaacaagcctaaattgctagaaagcactcctgtacctctccaccc
cgccaggctccaccaagctccctcataggtcctcattctg >IGR1119a
cgagcataagccacaaagactcaattttggggaaatttgtatcacctcttttcatttaga
agaatccatctgagtaccaggtaagagaactcagtaaacagcctggctttgttccttaac
aagcctaaattgctagaaagcactcctgtacctctccaccccgccaggctccaccaagct
ccctcataggtcctcattctgctcagcatgcctctgtgactgaggcacttttctctgctg
aaaagcccttccttcttatcccaggccaggtcaaaaacagactatggagcacctaccaa
ggtctccatcagacagactgtcagcagtttggaggagggacagggaaagatattcctgtt
tcccagagcctgacaagaaagtggcagagcaaggggttgttgaattctttttttatttttt TABLE 5-continued ctcttatagcctaatcttggaagtgaagggaattcttattcctgctgccactggttctca
gggtatgcagggatagctggagagctcctacgtatgttttctattcagtgaatacatat
gaaaccccaggtctgcaggtcaatgggctgtaagagaagagctgaccttgcagcaaaata
cttacaagtaaaattgaaaacaaaaccaacctgcctatttaacttggtccctggtccact
ctaaccattgccccattttcttgctccccgtcacaggag >IGR1120a
gagagctcctacgtatgttttctattcagtgaatacatatgaaaccccaggtctgcagg
tcaatgggctgtaagagaagagctgaccttgcagcaaaatacttacaagtaaaattgaaa
acaaaaccaacctgcctatttaacttggtccctggtccactctaaccattgccccatttt
cttgctccccgtcacaggagaagttgttataagaattatctatattctctgtctccatt
tcttttttcttttttttttctgagacagttttttctcttgttgcccaggctggagtacaa
tggcacgatcttggctcactgcaacctccgcctcccgggttcaggcgattctcctgcctc
agcctcctgagtagctgggattacaggctaggcaccaccaggcccagctaattttttgcat
ttttagtagagacgtggtttccccatgttggtcaggctggtctcgaactcctgacttcag
gtgatccacccgccctggcctcccaaagtgctgggattacaggtgtgagccaccgtgccc
ggctgctgtctccatttcttactacccattctctccccacccaacttgacccgggcttcag
ttccaactgtgccactgactgctcctcagtcattaacaacttccattttgtcaaatttaa
gggccacttcttagtccttatcttatttgactccaaatag >IGR1121a
ctcccaaagtgctgggattacaggtgtgagccaccgtgcccggctgctgtctccatttct
tactacccattctctccccacccaacttgacccgggcttcagttccaactgtgccactgac
tgctcctcagtcattaacaacttccattttgtcaaatttaagggccacttcttagtcctt
atcttatttgactccaaatagcattagattcttgatatatttgcttcacttggttttcaa
gataccacatcttttaaaatcttttcccacatcaccagctgcttatttactggatttgca
aacataactagtggtgggacctttcccttctctctctatgctcattccacatgtgatctc
atctcatgggttaaatgccgtggatatgctgatgactccccagtgtacacctttcacttg
aactctaggctcgaggttatatatccaactgcctgcttgacagctctgcttagatatcta
caggcacttcaaacttaaagtgtacaaaacggaactactgattttctctccccagtccca
cccattttagggaatggcaacctgttctcccaatatcctgttgttcaagcaaaaatatgt
aggagcaaccttggttattttactttccctcccttacactcaattcagaagcaaggcct
gtcaactctctctcagaacaaatcccaagtctatcactt >IGR1122a
gtgtacaaaacggaactactgattttctctccccagtcccacccattttagggaatggca
acctgttctcccaatatcctgttgttcaagcaaaaatatgtaggagcaaccttggttat
tttactttccctcccttacactcaattcagaagcaaggcctgtcaactctctctccagaa
caaatcccaagtctatcacttctctccattttcactgctaccacctgatctagcccacca
ccatctcttggttactacaagtctcctcatcagtctctgcttttactcttgcccttaca
atccattctccacacccagcagccagtgcaatttcttccaactagaaatcagattatatt
acttccctgcttcaaaccctccagtgactgcccaatgcagttagaatgaaataaaactgt
ttgtttaccaaggctacaaggcatgacatactctgggaatggtctatccctgactatatt
ccacccatgcttgccttcttcctggtccttgaacactttctgttcgtactggtcttggct
gctgcagtaactattctctctacctggaacgcctgcaccccattttttgcatatcttgct
cccttctcatcaatcaggtcccagcttaaaggcccatctgttatgctcacattgttcatt
tcactgtaatacctaccactactacccattttgttatta >IGR1123a
tcctggtccttgaacactttctgttcgtactggtcttggctgctgcagtaactattctct
ctacctggaacgcctgcaccccattttttgcatatcttgctcccttctcatcaatcaggt
cccagcttaaaggcccatctgttatgctcacattgttcattttcactgtaatacctacca
ctactacccattttgttattaatttatttcttaattttgtttcttcatccttatatactt
agtatctagaacagtatcaagcatttatgtactcaaattttattgaacaaaatcctaat
atacaactatgtattatgtacacaagcacctcactgaagagttacaaaatatatagaaat
aagttatggttctaaaccaggaagtataagtaacagttaaaatgcttttatataaatact
agttttttaacggttataaaaaaggtcatgcccgtaatcccagcactttgggaggctga
ggagggtggatcacttgaggccaggagttcaaaactagcctggtcatcatggcgaaacct
cgtttctactaaaaatacaaaaattagcccagtgtggtagcacatgcctgtaatcccagc
tacttagaaggctgaggcatgagaatcgcttgaacccaagaggcagaggttacagtgagc
agagatcacgccactgcactccagcctgagagagctgaga >IGR1124a
gccaggagttcaaaactagcctggtcatcatggcgaaacctcgtttctactaaaaataca
aaaattagcccagtgtggtagcacatgcctgtaatcccagctacttagaaggctgaggca
tgagaatcgcttgaacccaagaggcagaggttacagtgagcagagatcacgccactgcac
tccagcctgagagagaaccagtgagactccgtctccagaaaaataaaaaaaaa
agcaggggccactatggtagcagcatgtcacagtggttctgatatctaattttatctct
accatttacctgggtaatcttgggtagcctgcttaatctgtctgataaatacttgcccttt
taaaacagagttagatacaataattaaatcgattatgctatcatgtagtattcaattgct
attattgtcttctatgcacagccctcaacctcaaagaatgtttaaatgggaacagaaacc
tacgttttcttaatgaatttagttctttagtgctattaaagaatagagaatttaagaact
taacttacattaaagaatggaacatgacaaaggaagctggactaaatcgcctctgagctt
ttctgactctatactgaataatagtatagatttttaaaaattctattttatagatgagga
aacgaaaactcagagtgtctaaataatttgctaaatatct >IGR1125a
tagttctttagtgctattaaagaatagagaatttaagaacttaacttacattaaagaatg
gaacatgacaaaggaagctggactaaatcgcctctgagcttttctgactctatactgaat TABLE 5-continued aatagtatagatttttaaaaattctattttatagatgaggaaacggaaactcagagtgtc
taaataatttgctaaatatcttcagtcaggactcaaaatcaccactatggagaatagtat
ggaggttcctaaaaaaactaaagacagaactaccatatgattctgcaatcccacttactg
gatatttacgcaaaggaaatgaaatcattaggttgaggagatatctgcactcccatattt
attgcagcactgttcataatacctaagatttggaagcaacctaagtgtccatcaacagat
aaaatggataaagaaaatgtggttcctctcgggcgcggtggctcacgtctaattccagcac
tgtgggaggctgaggcgggtggatcatttgaggtcaggagttcgagatcaatatggccta
catggcaaaaccctgtttctactaaaaatacaaaaattaccaggtgtggtggcaggaac
ctgtaattccagctactcggaggctgaggtggaggttgcagtgagctgaaatcacaccac
tgcacttcagcctgggagacagagactccgtctcaaaaaa >IGR1126a
tggatcatttgaggtcaggagttcgagatcaatatggcctacatggcaaaaccctgtttc
tactaaaaatacaaaaattagccaggtgtggtggcaggaacctgtaattccagctactcg
gaggctgaggtggaggttgcagtgagctgaaatcacaccactgcacttcagcctgggaga
cagagactccgtctcaaaaaaaaaaaaagttgttcatatatacaatggagtgctattca
gccataaaataaaatgagatcctgtcatctggaataacatggatggaactgaaggacatt
atgttaggtgaaataagccaggcacagaaagacaaactttgcatgttctcattcatttgt
gggagtgaaaaattaaaacaattgaactcatggagatagtggagatgatagttaccagag
actaggaagggcagtggagatggttaacaagtacaaaaatatagtaagaataagatctag
tatattatagcacaacagagtgactacagtcaacaatgtattgtacatttaaaaataact
aaatagtataattggaatgtctgtaacaaaaggaaggataaatgcttgaggtgatgaaa
cctcatttaccctgatgtgattattatgcattgtatgcctgcatcaaaatatctcacgta
ccacataaatataccggctatatagccataaaaaataaga >IGR1127a
gtgactacagtcaacaatgtattgtacatttaaaaataactaaatagtataattggaatg
tctgtaacaaaaggaaggataaatgcttgaggtgatgaaacctcatttaccctgatgtg
attattatgcattgtatgcctgcatcaaaatatctcacgtaccacataaatataccggct
atatagccataaaaaataagaataaaaactttttttaaaaaaaagaattcggccgggcgcg
gtggctcacgcctgtaatcccagcactttgggaggccgaggcgggcggatcacgaggtca
ggagatcgagaccatcccggctaaaacggtgaaacccgtctctactaaaaatacaaaaa
attagccgggcgtagtggcgggcgcctgtagtcccagctacttgggaggctgaggcagga
gaatggcgtgaacccgggaggcggagcttgcagtgagccgagatcccgccactgcactcc
agcctgggcgacagagcgagactccgtctcaaaaaaaaaaaaaaagaattcaaaatctgg
acatctgtagtgttcagagacagcacttttaaccatgtattatggacttctgaggcttttt
taaaaaaggtaaaacttatcatgttggacttttatacaaagtccaatgtcttgcttttaa
tatccatttttattttccatcacaaccaacttatcttat >IGR1128a
gactccgtctcaaaaaaaaaaaaaaagaattcaaaatctggacatctgtagtgttcagag
acagcacttttaaccatgtattatggacttctgaggcttttaaaaaaggtaaaacttat
catgttggacttttatacaaagtccaatgtcttgcttttaatatccatttttattttcc
atcacaaccaacttatcttattccaaatagaagttttggtgattttttttttttttttt
ttttgagacagggtctctttctgtcacccacgctggagtgcactggcacaatcttggctc
attgcaacccgccacgggcttctgagtagctgggattacaggtgtgtgctaccacgccca
gataattttgtatttttttgtagtgatgggtttcgccatgttgcccaggttggtctca
aactcctggacttaagcaatccacccactttggactcccaaagtgctaggattacaggcg
taagccactaagcctggcaaaatagttttaccaacaaaaatctgttttgatttgtgtc
tcttcaaataaactataatatccttgctagaagttactggatctcctattccttaatgct
caatgaatgtttgataagtctattagatacacagcatctgttgttaaagaactaagaaaa
actaaaaagtcccctaaaggcataaatgaggtagctgaga >IGR1129a
aaataggttttaccaacaaaaatctgttttgatttgtgtctcttcaaataaactataat
atccttgctagaagttactggatctcctattccttaatgctcaatgaatgtttgataagt
ctattagatacacagcatctgttgttaaagaactaagaaaaactaaaaagtcccctaaag
gcataaatgaggtagctgagaagactaaaaagaattattaaaggcaaaaaaaaccaaaaa
acaaaaaacaaatatatgtatgtgtagtctactgggcaagaattccttaagttttgctta
tgttcttgtttcagcaccttaaattccaagactaaccactttaaactgctggatctaata
tctaggagagatggcaatattcaaagaagttaaaaaacaaaagttctcatttggtgcagg
catataattctatgagccattttggacccagggaacattgtaatgttaacgtacccactc
acaatgaaatgggacaaaagatatatccatggaatactctcaaaaaattgttttaaaagt
taaacttaatctaacaaaaatcttagtataatttattttaaaaaataacatgttaattg
gctcactcccaatatttcacagtaaatggatctaatttgtcttacatgattacgtacttc
ctaaaacttgtatatgccaaaaatatgcctaggcaattct >IGR1130a
gatatatccatggaatactctcaaaaaattgttttaaaagttaaacttaatctaacaaaa
atcttagtataatttattttaaaaaataacatgttaattggctcactcccaatatttca
cagtaaatggatctaatttgtcttacatgattacgtacttcctaaaacttgtatatgcca
aaaatatgcctaggcaattctgggaccaccttgttatcatcactaactaaaaaagtcct
catactgaaccagagttctcctgtcttcctgagccctgtggtctgaatgccactgctca
ggttggtctgttgactatgctgtatctgaccagaagtcttagaagagaagctctctgtgt
aactctcttagtgctaaggaagatatttgccattctggaaaaaacaaccaccaccaaaat
ctaaggtaagtaataattctcctgccacaaatgaacagaactactagatagacttataac
aaaacttattttaaattcatagttgagctcacaagaaagaaagggaaatccctacataat TABLE 5-continued agaaacgaagatagaagtgaaaaccagaccagtcagtatgtaacctgacagacaaactaa
acttgggggttattattattactgttattgttagttttgagacagagtctcgttctgttgc
ccaggctggagtgcagtggtgcaatcttggctcactgcaa >IGR1131a
tagttgagctcacaagaaagaaagggaaatccctacataatagaaacgaagatagaagtg
aaaaccagaccagtcagtatgtaacctgacagacaaactaaacttgggggttattattatt
actgttattgttagttttgagacagagtctcgttctgttgcccaggctggagtgcagtgg
tgcaatcttggctcactgcaacctctacttcccagttcaagcgattctcctgcctcagcc
tcctgagtagctggcattacaggtgtgcaccactacagccagctaattttttgtattttt
ttagtacagacgggtttcaccatgttggccaggctggtcttgaactcctcacctcaagt
gatccgcccacctcggtctcccaaagtgctgggcttacaggcatgagccaccgtgcccag
ccatgaacttggcgttattgtttttataacctagggattggttcttatcatccaggacag
aagatgaaggataggacccaagtaaggaagaagattagaagtgactcccaacacacaaaa
aatgggactcttcaagagctataacatcaatcctcaatgaaagagtggaaaattaatgag
ttgaaaattcaaagtcttgggcaaatgctttatatagttttggggttcaaagttatgcta
ccagtgagtatagtctaggaacctaccaactaagaaatta >IGR1132a
aagtaaggaagaagattagaagtgactcccaacacacaaaaaatgggactcttcaagagc
tataacatcaatcctcaatgaaagagtggaaaattaatgagttgaaaattcaaagtcttg
ggcaaatgctttatatagttttggggttcaaagttatgctaccagtgagtatagtctagg
aacctaccaactaagaaattaacaaaaaccctacatgcaggccaatgttttctctggagc
tcttagttaatataaaaccaaaatttctgtgtagatggacctctacaaggaaaggtcaca
agggagtctcatagaaaaaacaacactactaaagataagcacacaattaaatgttaataa
aacacagaaacttcactagggggatagaatcaacatcaaaacagcagaagcagactcctc
aaaatgtgaattaaaaaataacaatctgaaagagaatataaaatgtgtatagttaaaat
gagtaaagacacattcaagaaggaatcaaaatactaaggaagaaaatacatcataagcct
ggcacagtggctcacatctgtaatcctagcactttggggaggcctaggtataaaatgtgta
taaaatgagtaaagacacattcaagaaggaatcaaaatacaaaggaagaaaatacatcat
aggcctggcgcagtggctcgcatctgtaatcctagcattt >IGR1133a
aaggaatcaaaatactaaggaagaaaatacatcataagcctggcacagtggctcacatct
gtaatcctagcactttggggaggcctaggtataaaatgtgtataaaatgagtaaagacaca
ttcaagaaggaatcaaaatacaaaggaagaaaatacatcataggcctggcgcagtggctc
gcatctgtaatcctagcatttttgggagaccctaggcaggaggatcgcttgaggccaggagt
tcaagaccagccggggcaacatgacaaaaccccatctgtaataaaaatacaaaaattagc
cgagtggtggcatgcatctgtaattccagctatctgggaggctgaggaatgagaactgct
tgaactcaggaggtggaggctgcagtgagccgagatcatgccactgcactctagcctggg
cgacagagccagactctgttttaaaaaaaaaaatttataaaaaaaccatgtgagttttctg
aaaaagaacaaaatagaacttatagaaaaaaatggaggaaaaaatgacaactcaataggc
agtataagtagcagctaaataatttatttaacaagatatttacccagagcccagtatatg
caagaggggttaagcaatgtagaggaaagaggaggttatgtctaataaaaagtgaagaag
gggaaaatagtgagaaatggagaaagaataatatttgaag >IGR1134a
ttatagaaaaaaatggaggaaaaaatgacaactcaataggcagtataagtagcagctaaa
taatttatttaacaagatatttacccagagcccagtatatgcaagaggggttaagcaatg
tagaggaaagaggaggttatgtctaataaaaagtgaagaagggggaaaatagtgagaaatg
gagaaagaataatatttgaagagataatgtatgaaaaatccccaaaattgatggaagata
tcaatcctcagatcaaaaagcataatttatgagcagaagaactaaagctgagtctagaca
cactattataaaatacagaacactgaagacaaagggaaaaatcctaagagaaccagggg
aaaaaggcagattacttttaaaggaataattaaaatgatttctcaactgtaaccatagag
gccaacaaaaatgaaatatttcaaagtgccaagagaacaaaactgtcaatctagaact
ctatgctcagctaaactatcaaattaaggggaaaaacttctcaaagactgattgtttacc
actaacagtcattcactgaaaaactattgaagaatatactccaaaaaaagaaaactgaa
cctaaagaagggaggagtgtgggatttaaaaagcaagaatgaacaaagaaattgggaaacat
gcgggcttatgaaaccaccacaataattattactcatttg >IGR1135a
caaattaaggggaaaaacttctcaaagactgattgtttaccactaacagtcattcactga
aaaaactattgaagaatatactccaaaaaaagaaaactgaacctaaagaagggaggagtg
ggatttaaaaagcaagaatgaacaaagaaattgggaaacatgcgggcttatgaaaccacc
acaataattattactcatttgtgatgatttaaaaacaaggtaaaactaaaatattagaca
aaagaaataatgcagatgagagaagataattagtattcaggaaaaagataaaacaattca
cattaaagctatggttttttaaactttgatgtgcatcagaatcacccaaaatgtctgtcaa
aaatagactgctgggccctacctctcaaattttttgatcgaggtctggggtagaagctgag
aggcatttctaacatgttccaaggtgatactgataatggtgctccacgaccactttgaga
actaatgcatatgattttaagtcaaataagtatttaaaaattaaaaagtaaacactcaaa
taactaaagtagaatacaacccgatccttgaacacaggtttgaaccatgtgggtctatgtt
tatgtagatttttcttccacctctgccatccgagacagcaagactgacccctcctcttctt
cctcctcctcttcaatgtgaagaggacaaggatgaagacc >IGR1136a
agtcaaataagtatttaaaaattaaaaagtaaacactcaaataactaaagtagaatacaa
ccgatccttgaacacaggtttgaaccatgtgggtctatgtttatgtagattttcttccac
ctctgccatccgagacagcaagactgacccctcctcttcttcctcctcctcttcaatgtg
aagaggacaaggatgaagacctttatgatgattcatttccacttaacagaaaatatattt TABLE 5-continued tcccttataatttttttcttgtctccagtttactttattgtgaaagaatactgcatataat
acacataacatacaaaatatatgttaatcaactgtttctgttatcagtaaggcttccagt
caacagtaggctattagtagttaagttctgagggaatcaaaagttatatgtggatttctg
actgcgtgggggcttagtgtccctaatccccatgttatatggtcaactggataacccaa
agaagggaaaaggaggagtcaagaaaaataaatccatctcaaaaaggcaggaaaggaaa
aaaagatggcagaaatAaatccaactcaattgagtaatcagaatgaatatgaaaggccta
aattcactggttaaaagacagacatacactggataaagaaaattctgctatatgtaatta
agatggtgagagaaatggcacagagatagacaaagtgatg >IGR1137a
tcaagaaaaataaatccatctcaaaaaggcaggaaaggaaaaaaagatggcagaaataaa
tccaactcaattgagtaatcagaatgaatatgaaaggcctaaattcactggttaaaagac
agacatacactggataaagaaaattctgctatatgtaattaagatggtgagagaaatggc
acagagatagacaaagtgatgaattaagtagaacagagaacccaggccaacccaggcaca
tagggaattctgatatatgacagaaatgacactgtaggtcactgagagaaggatagtcta
caataaatagagccaagacaaccagttattcataacggaaaaaattcaacttagaattaa
atacttaaatgtacttacatgtgaaaggcaaaatttaaaactttagacaaaaatataga
agtagggcgtggcagctcacgcctgtaatcccagcactttgggaggccaatacaggtgga
tcacgaggtcaggagatcgagaccatcctggctaacacggtgaaaccccatctctactaa
aaatgcaataaaattagccgggcgtagtggcgggcgcctgtagtcccagctactcaggag
gctgaggcaggagaatggcgtgaacctgggaggcagagcttgcagtgagccgagatggcg
ccactgcactccagcctgggcgactgagtgagactccgtc >IGR1138a
agaccatcctggctaacacggtgaaaccccatctctactaaaaatgcaataaaattagcc
gggcgtagtggcgggcgcctgtagtcccagctactcaggaggctgaggcaggagaatggc
gtgaacctgggaggcagagcttgcagtgagccgagatggcgccactgcactccagcctgg
gcgactgagtgagactccgtctcaaaaaaaaaaagatatatctctctctctctctctct
atatatatatatatcttatatatatatatcttatatatatatatatagagagagagag
agagagagaggagtagagagagagagagagagagagaggagtagggaaggatttct
taacaagacacacaaagagctaaccagaaaaggctgctaaattcaactaactcaaaatca
aatccagtgtcatcaaaagatgctaagtaaaaagataagcataatgtttgaaaagacat
ttgtaatacatataactgaaaaggaattgaaatgcagaagagataacacatttaaa
tcaataagaaaagaccaatagggccaggaacaatgcctcacacctgtgaccccagcactt
tgggaggccgaagtgggaggaatgcctgagcccaggagtttgaggttacactgaactatg
attgcaccattgcactctagcctaggtgacaaagagagac >IGR1139a
aaaggaattgaaatgcagaagagataaagaacacatttaaatcaataagaaaagaccaat
agggccaggaacaatgcctcacacctgtgaccccagcactttgggaggccgaagtgggag
gaatgcctgagcccaggagtttgaggttacactgaactatgattgcaccattgcactcta
gcctaggtgacaaagagagactctgtcccaaaacacacaaaaagacaagactaataatgt
ataaacaacgattcatcatttaaacctatgaggttggcaaacattaagaaatttataaa
accaatgtcagaggatccatcaaataaaccttatatactgctagtggtataaatcagta
gtcatttctggaaaacaatattattttgtaaaattgagcatactccacaatgcactccca
caaatataaccttataccttcctccagaagacatgacaagaccctggaaaaaaacccaa
atgtccatctgtaggagaatgaatgcattgtggtctattcccatagtagattatgtacat
cagtgaaaatgaatcaactacggccataaacaacatggataaacaaaagcaaatccaaat
aaaaaagcaagtcctagaatatcatatcatttttaaaaagctcaaaatatgacatatata
tgataaaactgttttttaaaaaagcagagaaagtaaaaat >IGR1140a
tgaatgcattgtggtctattcccatagtagattatgtacatcagtgaaaatgaatcaact
acggccataaacaacatggataaacaaaagcaaatccaaataaaaaagcaagtcctagaa
tatcatatcatttttaaaaagctcaaaatatgacatatatatgataaaactgttttttaa
aaaagcagagaaagtaaaaatctttgtcactggttatagggaatggggatgacagaaggt
tgagataagaagggagcatctaagtggatgccaatcagtgataatggtagattggttaga
gggaggtagtatcatgaatactcgtagatattaatatgctttatatcttaacttcataac
ttaagctagtgtgtgtttacatacatacatacatatattttccaatccatggtatacata
aaataccatatttaaagagaaaaaatgaggggctgggcgcagtggctcatgcctgtaatc
ccagcactttgggaggccgaggcgggtggatcacctcaggtcaggagttcgagaccagcc
tgancnacatggnngaaaccnngtctctactaaaaatacaannattagcnnngcgtggtgg
cangcncctgtaatnccagntacttgggaggntgaggcagnnnaatcnnttgaacccggg
aggcagaggttgcagtgagcngagatngtgccattgcact >IGR1141a
aggcgggtggatcacctcaggtcaggagttcgagaccagcctgancnacatggnaaacc
nngtctctactaaaaatacaannattagcnnngcgtggtggcangcncctgtaatnccag
ntacttgggaggntgaggcagnnnaatcnnttgaacccgggaggcagaggttgcagtgag
cngagatngtgccattgcactccagcctgggnaacaagtgaaactctgtctcaaaaaa
nnntaaaannnnnaagaaaaaaagaaaaannnnnanaanngnnnannaannnannttnn
nnnatntnaantgcantannnnaaatccccagtctaatacttactggtcaagagtcttata
ataaatatccagatccttgttcacaagttctgttgtcctcataacaatcatcatttctct
atacttttcctcagcatcccgaaattgtggttctcgaagttctttcttaaaatgaataat
ttcttcttcataaccttttctgtcgccctaatgccaaattatgatttcttttttatattgtc
tatgttctcttccaacttctgatgttcactgtaaaaaagaaaaatgacaaatgaggacca
ttttttagcttttaacaacctgaagtggaaaagtcatagattctcttagataggttaagt
atcattctccttagcaatcagtatattataacagagtctc TABLE 5-continued >IGR1142a
tgtcgccctaatgccaaattatgatttcttttttatattgtctatgttctcttccaacttc
tgatgttcactgtaaaaagaaaaatgacaaatgaggaccatttttttagcttttaacaac
ctgaagtggaaaagtcatagatttcttttagataggttaagtatcattctccttagcaatc
agtatattataacagagtctctccttgcttattatttagggctttggtactaaagaaaac
ccctctcttccttccatatctctgccgcacataggttgctaaatagctaattttgtgtat
tacagaaccctcatagcatgtgatcactgataaagttcctggcctttagacgctaagtaa
agcactctggtgattaatattacaaattcacaatcttctgattgtgaactgagaatgcac
aattatcaacactaagaagttatggataacaggcttcatcatcattttgctcatgtcaaa
ggcacaatacgaattaaatcatatattaattttctgcagtaatacttattaaaaatttag
attcctccatgaaaacaaaatttctcttgcacaagtgtaaaaaccataataatgaccaaa
aaagtaaaatattcaaactttttctgatattttggcagattatacaaatttcaatgtatgc
tttaaaaatcttcatttatttattatcacttattaagcat >IGR1143a
catatattaattttctgcagtaatacttattaaaaatttagattcctccatgaaaacaaa
atttctcttgcacaagtgtaaaaaccataataatgaccaaaaaagtaaaatattcaaact
ttttctgatattttggcagattatacaaatttcaatgtatgctttaaaaatcttcatttat
ttattatcacttattaagcatcctcttatgtgtcaggcactactctcaagcttatgggca
tccttacagagtcgactggattacaagtcttgttggcatttctgttatgtcctggttgaa
gaaacgtttgaaaaatagttgtacttagtaatgtgaatgaattgtaaaaagtactgttatg
taccaattacagaagaaatttttttaaatatctggttttggtcttagtagccacgaatat
attattttatatcaaaatttcttctagaagcattacttttccaacttgccatggagagta
tcgtgtaaaagaactgaggcttgggaactaggatattagggtcacattcttggctttcat
cataatttcctctgtgattttctgggtctaagtgtgcataatgcatacaaaaatgaaga
ctctgaagatgatgagctcttctagttaaaaatctgatttccctgatataggaaagagat
tttaaatagctaagagtacttaaccaaaacacaggattaa >IGR1144a
cttgggaactaggatattagggtcacattcttggctttcatcataatttcctctgtgatt
tttctgggtctaagtgtgcataatgcatacaaaaatgaagactctgaagatgatgagctc
ttctagttaaaaatctgatttccctgatataggaaagagattttaaatagctaagagtac
ttaaccaaaacacaggattaaccatttgttaggctttataaaattaaaattcacttacta
tatccttttagaaaagcctgggcattttttcattcagatttctgtataaattcaagaagac
atgaaaactctacaaggaagggtttaataaatgagaggcctggatttaaccagctgaggt
ggttgacaatctaagtatttgcctagtacaaccttttataccagtctagtgccttagcat
caacaaggttcttacagaattcctaaggcaactaactctcaaggcagtcaaggcaggaata
aaatcttttctgctgtaccaggaaggtagcaactacaataagtaacaataagaccagata
aaggaagaatgaggctcatctttcaaaagaaatgctctggtggacacataattacaaatg
agaaaatctaaaatgaatctctgtggataaatcactctggcaacaactccattgacaata
ttatagactgtacaagctctgacccagacaaggtccacag >IGR1145a
aggaaggtagcaactacaataagtaacaataagaccagataaaggaagaatgaggctcat
ctttcaaaagaaatgctctggtggacacataattacaaatgagaaaatctaaaatgaatc
tctgtggataaatcactctggcaacaactccattgacaatattatagactgtacaagctc
tgacccagacaaggtccacagctccatattctttatgcttagtaccactattctgtgcag
caggctagcagatgtatgggggctaagcatgttcaatactgaataactaaggcccatcac
tacagtgtgattaccaattctatatcacttcttcagtaataaagttcttaaggccatgaa
atataattgtatcaaaacactgttcaccttctagtaactctcaaaggataccaggctgag
gctaaaattcttttaaaacaggtatttaatattcttcacattccagtaataaagacgttt
atttaaactgaagattattttaaaagcatacctttcatttgcaaaacctgcatttgacc
catttccttcaaatgttgttttctttcttcttcaacttcttttagttcctcatttctttt
tcttaaagtaaggttatcttgtagccacctttcttgtatctaaaggtaaacattaaatta
gttaacaaaaataaccaagttactaacatgaaatctgtaa >IGR1146a
ttaaaagcatacctttcatttgcaaaacctgcatttgacccatttccttcaaatgttgt
tttctttcttcttcaacttcttttagttcctcatttcttttcttaaagtaaggttatct
tgtagccacctttcttgtatctaaaggtaaacattaaattagttaacaaaaataaccaag
ttactaacatgaaatctgtaacaggcaactggtgacagcaagtgccatttctgtcttact
tagaatcatgtgaaattcaacagagggagaataagccagtgtgaaggaatctaacaggtct
ggggcaatctggatggcccatcccatccacagtgacaagtgtaataacctcctgtagcgc
agctttttactgctcttccacaaccataatctaaaaaccaggtctactgtttgatggggag
tctcataaagatttgagcatatatctgtgtacttatttacttataaagtattaaaaacat
acaaaacagacatttaaatggtgaaattaaaaatataactagatattttaatacctaca
tccccagtggatcattttgcataggaacccccatgataaagcctactgacctgaaagatta
taagagatcaatactactactgaagtcttccccaactttttcgtcctagttctgtctccc
aacatgtaccaagaccattagaacctgttaggtatatgtt >IGR1147a
tggtgaaattaaaaatataactagatattttaatacctacatccccagtggatcattttg
cataggaacccccatgataaagcctactgacctgaaagattataagagatcaatactacta
ctgaagtcttccccaactttttcgtcctagttctgtctcccaacatgtaccaagaccatt
agaacctgttaggtatatgttacctgcaacttctacctttaggttgacaaattgtaatca
ctcaaggcagtaagaagtgccacaatagtagcatatatctatgaacttggtacctcctta
gccaccgaaatgaaatttcaaaaaattggctgttcttgttgagtagttttgtccttcaaa
agagactcaataacacttagcagcagcagcaacaacaacaaaattatttcagtggttttc
ctggtgattaaaatgaactatgttgtcaagagacaatcattagaaaacagttttttaagtt TABLE 5-continued gattctttggaatttagaggaaaaaaaatttcctgcagaaagaagggtgatttggcccac
aaatcatgtgtatagaaaacttattctgaatttggagtaaggatttctcaaagagggagc
tgggaccctcctgcaatagcccttgcagctaagctaaactcagtgacatgggaagtgaga
gagatggacagacctgtggcaatatcttgcaccaacagta >IGR1148a
gaaaaaaaatttcctgcagaaagaagggtgatttggcccacaaatcatgtgtatagaaaa
cttattctgaatttggagtaaggatttctcaaagagggagctgggaccctcctgcaatag
cccttgcagctaagctaaactcagtgacatgggaagtgagagagatggacagacctgtgg
caatatcttgcaccaacagtaaaaggccagggactggtagatgagagagggaaatcaagga
tttctctcacatgcttaatgttcatatccaatcctgcccctctatgcgtgactatttta
gagttttttttttcttttttaacagtcacaaagtaaggctactttcattttttcctggaaa
taatataaacatacaatttatccacagggtccacatctacggattcaactaaccatggat
caaaaatattggggaaaaaaataaaaagtaatagtacaataaaaaaatacaaatttaaa
ataatacaatataaaaactacgtatcatttacatattaatatcaaaagcaatctagagat
taaagtatatcagaggatatggataggctatatgtaaacactagatatgccatttttatat
aagggacttgagcatcctagatttcggtatctgttttatcggggatcctggaaccaatc
cctcccagagataccgagacaactgaatatgtatctacta >IGR1149a
acgtatcatttacatattaatatcaaaagcaatctagagattaaagtatatcagaggata
tggataggctatatgtaaacactagatatgccatttttataagggacttgagcatccta
gatttcggtatctgttttatcggggatcctggaaccaatccctcccagagataccgaga
caactgaatatgtatctactaaaggcattattataggcagttaaaggtgactaaaatgac
atggttataaatgtcctttgttgctaaagcaatctaatgtaccactgtagctggtgtgac
ttaccaaggttctactatggggtactatgcttgttgttccttattaggaacaagggaatg
tgctactgcttactttcatctaatacccagaacatttgaatttgttttcacaattgcat
gaaaggactctttaaagtgctatcacattttagatgagactgattttggcacaaaata
ttgttgctggtctgtctacctgcattgttaccagacagctaggcatttctttgttttagg
tcagcttccattattcttctagttttgaaagacagtatataccacatcaagagtgtaatg
ctttgaagtcagatacatctaggctcaaatcacagtgttattacttttaaactggataac
tttgggcaaattagtttaaattctctgaacctcagtttgc >IGR1150a
ctgcattgttaccagacagctaggcatttctttgttttaggtcagcttccattattcttc
tagttttgaaagacagtatataccacatcaagagtgtaatgctttgaagtcagatacatc
taggctcaaatcacagtgttattacttttaaactggataactttgggcaaattagtttaa
attctctgaacctcagtttgcttataacatggtcaataatgatactatctatcataaaga
actattgtgtggccgggcgtggtggctcatacctgtaatcccagcactttgggaggccaa
ggcagatggattacttgaggtcaggagttcgagatcatcctggccaacatagtgaaaccc
cacctctactaaaaatacaaaaattagccaggcctggtggcactcgcctgtagccccagg
caggttgaggcaggagaatcacttgaacccgggaggcgaatgttgcagtgagccgagatt
gtgccactgcactccagcctgggtgagagagcaagactccatctaatttaaaaaaaaaa
aaaaaaaaaaagactattgtgaagattaaaggaatgagtgtatgtaatcagtatagtgc
ctgactcaataattgctaataaaatgccttttgggtcaaatttgtcctttgtactgtaag
cagtgagaattccaattatagtctacaaaatgtatcagag >IGR1151a
tgggtgagagagcaagactccatctaatttaaaaaaaaaaaaaaaaaaaaaagactatt
gtgaagattaaaggaatgagtgtatgtaatcagtatagtgcctgactcaataattgctaa
taaaatgccttttgggtcaaatttgtcctttgtactgtaagcagtgagaattccaattat
agtctacaaaatgtatcagagaaaggaagggaaaaaaaatcagatgcagttatagtatac
cacaaatgttttccattctactagaaatttgatagtgtagggtccagttctacctgtta
ctacttttgtgaccttggacaagtcaggtcacctacagttctcttcatatattccttca
gctgaaaactgagaaaggcagttaagtttccaaattattttattctgtggactaaattta
gcagggcttaaatcagtacgtaaataagtgactgttaggctcctcagctcttaaatatta
accccaatcatccaactcagatgacagttaatgcatgcagctggtcacctatggaaacat
aaaaattagctgcattctagataccgtgagagagtggcatgctgaacagattacagtcc
aatgtccaccaaaagtctagctgggaataacaccacttctacaagactgcctgaaagcta
tgcagtccatccagtgctggctcagttattgacagctaaa >IGR1152a
gatgacagttaatgcatgcagctggtcacctatggaaacataaaaattagctgcattcta
gatacctgtgagagagtggcatgctgaacagattacagtccaatgtccaccaaaagtcta
gctgggaataacaccacttctacaagactgcctgaaagctatgcagtccatccagtgctg
gctcagttattgacagctaaagggatatattagaacctcaaggaatttcaacaaaacac
acatatctctgcccaaaccccaagattctgatttactggtgtggattggagacatagac
atatatatatatatttttgagacagggtcttgctctgttgcccaggctggagtgcag
tggcgtagtaagggctcactgcagccttgaactcccagctcaagcaatcctcccacctc
agcctcctgagtagctgggactacaggtatgcaccatcacacctggctaattttttgta
gagatggggtttcgccatattgcccaggatagtctggaactcccaggctcaagcaatctg
cccgcctcggcctcccaaagtgctaggattacaggcatgagccactgtgcccggccaaca
catgtattttaataacctaagtcattttttaaaaactgagatgtaattaatattccaca
aaattcactgtttaaacgtgtacaatttagcagttttact >IGR1153a
ttgcccaggatagtctggaactcccaggctcaagcaatctgcccgcctcggcctcccaaa
gtgctaggattacaggcatgagccactgtgcccggccaacacatgtattttaataacct
aagtcattttttaaaaactgagatgtaattaatattccacaaaattcactgtttaaacgt TABLE 5-continued gtacaatttagcagttttactttatttacaaggttatacaaccatcaccactatccaatt
ccagagcatttgatcatcccaaaaggaaatctcatattcaatagcagtcactctattcct
tcctcacctctagcccctggaaacattaatctgctgtcactggatttacctaatctgta
catttattataagtggaatcgtacattatgtgaccttttgtgactggcttcttttgctta
gcatgttttaagggttcattcatgtggtagcatgtatccttttatggctgaataatatt
ccattgtatgggtataccacattttgtttatctgatcatcagttgatggccatttgggtg
tgtccatattttgactattacaaataatgctgctatgagcattcttgtacaagttgttgt
gggaacatatgttttcaattttcttagttctatacctagaagtggaaaaactcagacgat
ttacaggtgcccctagctaagaacctttgctttctaaaca >IGR1154a
cattttgtttatctgatcatcagttgatggccatttgggtgtgtccatattttgactatt
acaaataatgctgctatgagcattcttgtacaagttgttgtgggaacatatgttttcaat
tttcttagttctatacctagaagtggaaaaactcagacgatttacaggtgcccctagcta
agaacctttgctttctaaacattaacatttacttcaggcttcaatcataccaccctctac
agaacctcgtatcaaggaataatgatgctgagatacactgtatttttttttaaagccctgc
gaagtctgttgaagactatacatgtcttcctttctatgaatagagacattatcctgtagt
cagtataggaaactggttttcttttagcattgacacaatgtgaatcttgactaattgtga
ctttttttttttttttttttttttaagacggagtctggctctgtcacccaggctggagt
gcagtggtgcgatctcggctcactgcaagctctgcctcccaggttcacgccattctcctg
cctcagcttcctgagtagctgggactacaggcgcccaccaccaggcctggctaattttt
gtatttttttagtagagacgggtttcggcgtgttagccaggatggtctcgatctcctgac
ctcgtgatctgcccgccttggcctcccaaagtgctgggat >IGR1155a
tcactgcaagctctgcctcccaggttcacgccattctcctgcctcagcttcctgagtagc
tgggactacaggcgcccaccaccaggcctggctaattttttgtatttttagtagagacg
gggtttcggcgtgttagccaggatggtctcgatctcctgacctcgtgatctgcccgcctt
ggcctcccaaagtgctgggattacaggcgtgagccaccacgcctgccttttttgtttct
gtttgtttgtttgtttgtttgagacggagtttcactcttgtcacccaggctgaagtgcaa
tggtgtgatctcggctcactgcaatctctgcctcccaggttcaagcgattctcctgcctc
agcctcctgagtacctgggattacaggcgcgtgtcaccacacctggctaattttttctatt
ttcagtagagatggggtttaccatattggccaggctagtcttgaactcctgacctcagg
tgatccgtctgcctggcctcccaaagtgctgggattacaggcatgagtcactgcgcctg
gcctcctctctttatttgactactagaatcttcagcaagcatatcagacttcatgcatac
tttttatacacttctctcctggtttcattactttcttgcccttatttctacactgccttg
ttttcccattaatttgaaatacatttatctttgctctatt >IGR1156a
tcccaaagtgctgggattacaggcatgagtcactgcgcctggcctcctctctttatttga
ctactagaatcttcagcaagcatatcagacttcatgcatactttttatacacttctctcc
tggtttcattactttcttgcccttatttctacactgccttgttttcccattaatttgaaa
tacatttatctttgctctattgtatataactaagtaaataatttctggaacaaggaaggt
tacaaagtaaactaataccatcagatccactaagtttagaccatcactttaaaagggtc
atagatcattaatcttaacaatttcgtatatatatacagagagctgctgcgaatttacag
attgtgattttttatataggcaactacataaaaagctagtgataattattttgttatatatg
catcataaatttatacagttattcaatatgtattaggccaggcagagatttgatctccct
ttgactgatatttcatatatttgaaattcttggtggtacagaaagagacccagcagaaaa
ctaatgtaactaatcttccaaatgattttaagcaaccacttataaccaagtggttaaggc
attcaaatagtaaattttgtttaaaacagtaagaacagagaaatggtatagttttttaaag
gcattaactaccatgcttgcataaagcatgtgatgatggc >IGR1157a
tttgaaattcttggtggtacagaaagagacccagcagaaaactaatgtaactaatcttcc
aaatgattttaagcaaccacttataaccaagtggttaaggcattcaaatagtaaattttg
tttaaaacagtaagaacagagaaatggtatagttttttaaaggcattaactaccatgcttg
cataaagcatgtgatgatggcttcttaatatgattttgattatactatagaaattaattt
cttaatagagaaaataaatgatataggaatcaactggaaaatgacttaatatatataaata
ttttccttacagattacttttcaagattattaaaccttaatccgtcttttgtgaatttatg
ctacataaagatatgttagaataagaaaagatacagatacatgttaaagatgttcattgt
cacacagtttgtgataaggaaatgaaatcaatctgagtaagtgctggtatatacacaaaa
tggactattttataatcattaaaaagaatgtgatacatctgtgagttgataggtaaaatc
aaattatgttaagtgaaaaaggtacagaataacatgatacgacccccatccataaaagta
aatttaaatatatatatatatatacacacacacctaaatttatctacctatctgctgg
tatatgaataaaaaacttctttaagaacaaataagtgtaa >IGR1158a
taaaaagaatgtgatacatctgtgagttgataggtaaaatcaaattatgttaagtgaaaa
aaggtacagaataacatgatacgacccccatccataaaagtaaatttaaatatatatatat
atatatacacacacacctaaatttatctacctatctgctggtatatgaataaaaaacttc
tttaagaacaaataagtgtaacagttaatgacatgtagaagtaagattgagaattaggag
aaggggaggaacacttttatgcctttatgttcgaacttttaccatgagtcttttactgaa
aataaaaataaaaaataaatgaagtaagaatgttattggaattattttttctttacttttt
gcatttcttttttagagacagagtctcgctgtgtcgcccaggctagagtgcagtggtacaa
tcacagtcactgcaacctctgcctcccaggtcaggtgattctcatgcctcagcttccc
gagtagctgggactacaggtgcgcgccgccacggccagctaattttttgtattttcagtac
agacagggtttcactgtgttggccaggctggtcttgatctcctggcctcaagtgatccac
ccgcctcggccttccaaagtgcagggattacaggtgtgagccaccacgcttggcctcttt
ccttttttgcatttctattcaatggatcttctattgaaaat TABLE 5-continued >IGR1159a
tgcgcgccgccacggccagctaattttttgtattttcagtacagacagggtttcactgtgt
tggccaggctggtcttgatctcctggcctcaagtgatccacccgcctcggcctttccaaag
tgcaggggattacaggtgtgagccaccacgcttggcctctttccttttttgcattctattc
aatggatcttctattgaaaatataaactatagaaaagaatgtcataggtgtaagtgatatc
ataagcaaaacagacctaccttctgtgtatcaatatcttgtctcatgagtctcatatctt
catttatctttcttttgtgtttctcgcattcacttagttgagctattacttttattaagtt
cagtttcttttttgctacaaaaaagaaaattctttaagcacatgaataaaaatacaatcaa
ataaataattttaagttttaaattaccttcttatagtcgtctttcccatcttgaatataa
ttctcaatgtctttcatatagccatgaatattttttaaccttctctttaatatcattcagc
tgtagaaaaatattcattaaatttacactggttgtacttaagggcacataacaggagagc
acagtaaaacactggctgggaagttatgaacattgggttccagtttccaccactactgaa
ttttatgatcgcagacaagtccctttctcacctataggaa >IGR1160a
agccatgaatattttttaaccttctctttaatatcattcagctgtagaaaaatattcatta
aatttacactggttgtacttaagggcacataacaggagagcacagtaaaacactggctgg
gaagttatgaacattgggttccagtttccaccactactgaattttatgatcgcagacaag
tcccttttctcacctataggaattgattaattagtctcatttcttaacttctattgtagat
caagcagcaaaataatttacatcaaatccttgttctaacaagaatttctaatgtcaaaat
tataccatgaatctgaaaatactatttatcttatgctatttaatttcatgtgaaataagt
gtccgacgtggtgctatgaacataagtttaatacagatatttgataagtaaatatataaa
tgaaatcttactttatcctgtgctatttttgttgcttgtatttttttttgttgattaattct
tcttttttcttgctggaacttttccaatgttgtttccaaagggcttacctgctctttagca
tcctaaaaatataaaaaagataaagtattatataatattccattatcttactttagggg t
cagacttcacagtcttaataaaagcactttctatgtgccaggctctaaaagtcaactcat
ttgctcctttcaatgaccctatgaggacagtaccatcatt >IGR1161a
tttccaatgttgtttccaaagggcttacctgctctttagcatcctaaaaatataaaaaag
ataaagtattatataatattccattatcttactttagggggtcagacttcacagtcttaat
aaaagcactttctatgtgccaggctctaaaagtcaactcatttgctcctttcaatgaccc
tatgaggacagtaccatcattttcagtcctatatttcaaacgagcaaacagacacagaga
atgatttgtccagggtcacaacagccagtaaatgaagcagccaagattttaacccagtcc
agctccagagttcacgctcttaaccactacgcatgctatactgcatcaaccactaatttg
attcttaatctaggccatgtgctcccaattatattagcgtgtggcttcaagcatgagttt
tcatgattttataggtgcccgtcactgctgcatgatcaaagaataggaaagctcattcag
tccagacttttcttttttcagatgaaaacatgatggtaaaaacacttctgtccttaagctt
agcctgctaaggctacgcagatatttcatggtaataaaagcatactgttaaactaatgtt
ggtgtctccacaactattttggaaggaacggggctttcaagtaataaaactatttttactaa
atagaagtccccattatttagccttgtaacactaaatcta >IGR1162a
gatgaaaacatgatggtaaaaacacttctgtccttaagcttagcctgctaaggctacgca
gatatttcatggtaataaaagcatactgttaaactaatgttggtgtctccacaactattt
tggaaggaacggggctttcaagtaataaaactatttttactaaatagaagtccccattattt
agccttgtaacactaaatctacaacgtagttatatgataaccacagttcaaaacagaggt
cctcaagcacttttaagattctgaagtactgagtgaatctatagaggtagatacaattatt
tagtaattacttcaatataggtctattttatcatactgggaagtggtatggtgtgttagg
aagtcaaatgccctcagtgtcaaaagatctatcagaaaatcaactctgcttcctattagc
tgcataaacttaggcactcatgagacatttgtaaatctcaattttttctataaagagattt
catcatctaaatagggttgctgaggcactgaatggttcaatgtcaaagtgctttataaat
agtaaaaaattatacagatgcaagtactattttatattatattctgaacctctgatatt t
tgtaatctaaaatttaataaaaatttatagtaattattcagtaatatacttagtgcttat
tgaatgagtacgcataattatataaacctaggtaagattg >IGR1163a
ctgaggcactgaatggttcaatgtcaaagtgctttataaatagtaaaaaattatacagat
gcaagtactattttatattatattctgaacctctgatattttgtaatctaaaatttaata
aaaatttatagtaattattcagtaatatacttagtgcttattgaatgagtacgcataatt
atataaacctaggtaagattgtttataactgtttataactggttgagtcttagatgtgat
taatctatataagggatgtcaaatgcattccagtggcaactgagtgcctgctcactgtat
tggtaagggttctgaaaccacatccggaatcaaatggaaagagtgctatgactgagagtg
accgccatagataaaggatctgcagataagacaaacctcctgtacaagcaggaatcctta
tacagaattaaccaaccaccacctgaccacctccaataacatttactacttaaccaggca
gccagttcttccttattatggcaaactccttcttccagaaatctttacttactagtacaa
gttctatcacttaggaaccacacaaataattattataccatttttcatttgatcctcataa
tagctggttttcaaagggaatgcttccagttttttgcccattcagtatgatattggctgtg
ggtctgtcataaatagctcgtattattttgaaatacattc >IGR1164a
ggcaaactccttcttccagaaatctttacttactagtacaagttctatcacttaggaacc
acacaaataattattataccatttttcatttgatcctcataatagctggttttcaaaggga
atgcttccagttttttgcccattcagtatgatattggctgtgggtctgtcataaatagctc
gtattattttgaaatacattccatcgatacctagtttattgagagctttttagcatgaagc
ggtgttgaattttatcgaaggcctttttctccatctattgggataatcatgtggtttttgt
ctttggttctgttcatgtgatggattacatttattgatttgcatatgttgaaccagcctt
gcatcccaggaataaagccgacttgatcgtggtggataagcttttttgacgtgctgctgga

TABLE 5-continued

```
ttcggtttgccagtatttattgaggattttttgcatcgatgttcatcagggatattggcc
tgaaattttctttttttgttgtgtctctgctaggttttggtatcaggatgatgctggcct
tataaaatgagttagggaggattccctcttttctattgttaggaatagtttcagaagga
atggtaccagctcctctttgtacctctggtagaattcggctgtgaatctgtctggtcctg
gacttcttttggttggcaggctattaattactgcctcaat >IGR1165a
tgtgtctctgctaggttttggtatcaggatgatgctggcctataaaatgagttagggag
gattccctcttttctattgttaggaatagtttcagaaggaatggtaccagctcctctttt
gtacctctggtagaattcggctgtgaatctgtctggtcctggacttcttttggttggcag
gctattaattactgcctcaatttcagaacttgttgttggtccatttgggatttgacttc
ttcctggattagacttgggagggtgtatgtatccacgaatttatccatttattattttct
agtttatttgcgtagaggtgtttatagtattctctgatggtagtttgtatttctgtggga
tgggtggtgatatccctttatcatttttattgcatctatttgattcttctctctttttc
ttctgtattagtcttgctagtggtctattttgttgatcttttttaaaaaaccagttcctgg
attcattgatttttttgaagggtttttcgtgtatctccttcagttctgctctaatcttag
ttatttcttgtcttctgctggcttttgaatttgtttgctcttgtttctctagttcttttta
attttgatgttaaggtgttgaattcagttatttcctgctttctcttgtgggcatttagtg
ctataaatttccctctacacagtgctttaaatgtgtctca >IGR1166a
gggttttttcgtgtatctccttcagttctgctctaatcttagttatttcttgtcttctgct
ggcttttgaatttgtttgctcttgtttctctagttcttttaattttgatgttaaggtgtt
gaattcagttatttcctgctttctcttgtgggcatttagtgctataaatttccctctaca
cagtgctttaaatgtgtctcagagattctggtacattgtatctttgttctcactggtttc
aaagaacatctttatttctgccttcatttcgttatttaaccggtagtcattcgggagcag
gttgttcagtttccttgtagttgtgcggttttgagtgagtttcttaatcctgagttctaa
tttgattgcactgtggtctgagagactgtttgttatgattctgttcttttgcatttgct
gagagtgttttacttccaattatgtggtcaatttagaataagtgcgatgaggtgctgag
agttctggccattacactaataaagagcatttcatattaaagaaacatgggctgggtgag
gtgatgtaagcctgtaattttgggaggccaaggctgcattgcttgaggccatgagtttga
gaccagcctgaacaacatagtgagaccctgtctctagaaaaattttaaaaattagccagg
cgtggtggtgtgtgcctgtagtcccatctacttgagaggc >IGR1167a
ataaagagcatttcatattaaagaaacatgggctgggtgaggtgatgtaagcctgtaatt
tgggaggccaaggctgcattgcttgaggccatgagtttgagaccagcctgaacaacata
gtgagaccctgtctctagaaaaattttaaaaattagccaggcgtggtggtgtgtgcctgt
agtcccatctacttgagaggctgaggcaggaggattgcttgagctcaggaggtcgaggct
gcagtgagtgagctgtgactgtaccactgcattccagcttggaagactgatgaagactct
gtctctaaaagagaagaatggggcggggcatgctggctcacgcctgtaatcccagcactt
tgggaggccaaggtaggcggatcaccttagttcaggagtttgaaaccagcttgtccaatg
gcgaaaacccgtctctactaaaaagaacaaaaattagccaggcatggtggtgcacgcctgt
aatcccagctactccagaggctgaggcaagagaatcacttgaacccaggagatggaggtt
gcagtgagccgagatcgtgctactgcactccagcctgggtgacagaacgagactgtctca
aaaaataaaaataaaataaattaaaataattttacaaaaaacatgtatggatattc
ttaccttatctctctgtacaaagactgaacttcagtgga >IGR1168a
gctgaggcaagagaatcacttgaacccaggagatggaggttgcagtgagccgagatcgtg
ctactgcactccagcctgggtgacagaacgagactgtctcaaaaaataaaaataaaata
aataattaaaataattttacaaaaaacatgtatggatattcttacctttatctctctgta
caaagactgaacttcagtggataattccacagtctgctcctccagttgctgacgacgttg
caaattagtggatatctgaagtttctcagatttttagctcatttgttgtacttttttagatg
ttgaatctgttcctgctggtcctgtataagcttacgattcaattcaatcttactagaaac
tacacaaaaacatattatcacagtaattaatgtaagggcatagaaaatactatttgtatc
attcttcccattttttatcggtctatggaatccacaaatgctatttctgtgggcccaccc
actgcaacaaaaatacaatgagaaccctgctagttctcaaatcagcttgatgttccctgc
tggccactcacagggaaagcttacagggcaggtatgaatgagaaagaatacagctcatgg
ccaggcgcactggctcacacttgtaatcccagcactttgggagactgaggcaggtggatc
acctgaggtcaggagttcgagatcagcctgacaaacacag >IGR1169a
gagaaccctgctagttctcaaatcagcttgatgttccctgctggccactcacagggaaag
cttacagggcaggtatgaatgagaaagaatacagctcatggccaggcgcactggctcaca
cttgtaatcccagcactttgggagactgaggcaggtggatcacctgaggtcaggagttcg
agatcagcctgacaaacacagtgaaaccccatctctacgaaaaaatacaaaaattagctg
ggcatagtgatgtgtgcctgtaaccccagctactcaggaggtgaggcaggagaatcact
tgaacccgggaggcggaggttgcagtgagccaagattgcaccattgcactccagcctggg
cgacaaaagtgaaactctatcttaaaaaaaaaaaaaggaaaagagaatacagcttattt
catactctcctactgttcaaaatctgttgtgcaaagtaagagaacaaagagaagtgatgc
ttttcagaaaaaaagagcaaatatatgtggacaggaaggaacttcgttgtccatgtaaca
gatataaaattgactgtaaaaggcatgtgctcgcaatgtcaaagtctctatgagtacaga
aggacacagactgtattacctgtgtctaacttgtgctgttcttcttgtttctcctggttg
acttgttggacagttcgatctaagtctattccttgtagct >IGR1170a
aatatatgtggacaggaaggaacttcgttgtccatgtaacagatataaaattgactgtaa
aaggcatgtgctcgcaatgtcaaagtctctatgagtacagaaggacacagactgtattac
```

TABLE 5-continued ctgtgtctaacttgtgctgtttctcttgtttctcctggttgacttgttggacagttcgat
ctaagtctattccttgtagcttagctgcttgttgtgcaattttctttcaacatctttaa
gttccatcttaagaatataacaaaatgatttcctttaataaacttactgcattattcaaa
atctttaaaaattaattgctcttatcatttatttttaaatctaaacttataaaccatttt
ctagatacaattttagcaaagtttaataggataaaagtgaaattaattatcagcaattca
aatgatgtaaacaaaggaagctgactaaagatgaaaaacaaacagaactgtcttaattt
ttaaatttatgaattaaaaagtttaaacccagggatgtaaactaagcagtttctccctga
gggtatctgaaattcaggatggggaattctaaacacaacctgtacctgaatactagctac
tattttaactctcacacttcaaattcaagccaccatggaacaagttttattctgcctta
aactacaataaacttacctggaacctctccataattgtaa >IGR1171a
agtttaaacccagggatgtaaactaagcagtttctccctgagggtatctgaaattcagga
tggggaattctaaacacaacctgtacctgaatactagctactattttaactctcacact
tcaaattcaagccaccatggaacaagttttattctgccttaaactacaataaacttacct
ggaacctctccataattgtaacatctgtcaggcatactttgcacttcttcttcaggca
ttattgtacccaagagtgtttcttgttcttctatgtcgttcttaggcgctgtatgtctc
tattgacattctgcagtttgtttcttaattctggtatttccttctccttcaaatcaatta
tgctttgcctaaatagaaaacacaattaaaaataaagtatctgatgtttctcacagttag
actgaggttatgtatttttaggaagaataccacagaagtgacattgtgttctttttcaggg
tatcatatcagtggatatggaatcatgatatcaatatgtcttattactgatgatgttaat
ccttattcacttggcttagatggtgttggccaggtttctccactgtaaagttactgtttt
agtctttgtaattaacaagtatcttaggagagaaatgttgagactatgtaaatatcttgc
ttctcaactttctgcctactgattttagtatccactgaca >IGR1172a
gaatcatgatatcaatatgtcttattactgatgatgttaatccttattcacttggcttag
atggtgttggccaggtttctccactgtaaagttactgttttagtctttgtaattaacaag
tatcttaggagagaaatgttgagactatgtaaatatcttgcttctcaactttctgcctac
tgattttagtatccactgacagatcttgcttgcaataattattactgtggtgtttgtcaa
actgagaaatattctactaatgaactggtcatattgaccaaaagtgttaaggtcatgaaa
gataaagacagattgttacagactgcaggagcctaaggagaaataacaactagatgctac
gtgggatcctgcatggaacctgaaacagaaaaggcattgatggaaaaactgctaaattc
gatatggtctgtaatttagttagtagcattatatcaatgttaatcctggttttgataact
gtattataacagagtacataaaattgttaacatcaggaggagctggatgagggatatatat
gaataatttgtattattttataattttctgtaatcctaacattatttcaaaataaaaa
ttttttaaattacaggaaaaaaaggaaggaagccagccactaagtgaaatgctacatggg
tttaaggtacaaaatgtcaacccatttttactggtactcac >IGR1173a
aaattgttaacatcaggaggagctggatgagggatatatatgaataatttgtattatttt
tataattttctgtaatcctaacattatttcaaaataaaaattttttaaattacaggaaa
aaaaggaaggaagccagccactaagtgaaatgctacatgggtttaaggtacaaaatgtca
acccatttttactggtactcactactgtagctaatgaattaccacctccatggcaggtact
gacaactattttgctgatgcctctgaaacaataatatgtatttaatcttttaaaaaaaa
tttacttcagaaatattccaaattcttatttaaaattatattgaattagtatgacaaagc
agtagaataaaattaaactggtctctaataggagtcttattataaacttaaagaataacca
gaaactcaagtggctattacttaatgatttttttaaaaatgcaaactatgaccaagaaatg
ccaacctgacctgtggcaacagacctatagttttttaaaattttttaattatttatttat
ttttatgctttaagttctgggatacacgtgcagaacgtgtgggtttgttacataggtata
cacgtgccatggtggtttgctgcacccatgaacccatcatctacattaggtatttctcct
aatgctatccctcccctagccccccaccagcagacaggcc >IGR1174a
cagacctatagttttttaaaattttttaattatttatttatttttatgctttaagttctg
ggatacacgtgcagaacgtgtgggtttgttacataggtatacacgtgccatggtggtttg
ctgcacccatgaacccatcatctacattaggtatttctcctaatgctatccctcccctag
ccccccaccagcagacaggccccagtgtgtgatgttccctccctgtgtccatgtgct
ctcattgttcaactcccatttatgagtgagaacatgcaatgtttggttttctgctcctgt
gttagtttgctgagaatgatggtttccagcttcatccatgtccctgcaagggacatgaac
tcatcctttatatggctgcatagttactccatggtgtatatgtgccacattttcttat
ctagtctatcattgatggtcatttgggttggttccaagtcttttgctatcgtgaacagtgc
cgcaataaacatatgtgtgcatgtcagacctacagttttttttttataccacagaaatagg
aggtatttgtattccacataataaatatgaaggtatgcaggttatgagtaattccatgcc
aatgtttcctcttgaacactgttgtcacagattagtagttggccttaaattatgtgccca
atatctaaaaagtgacacagctatgacagcctaataatga >IGR1175a
catgtcagacctacagttttttttttataccacagaaataggaggtatttgtattccacat
aataaatatgaaggtatgcaggttatgagtaattccatgccaatgtttcctcttgaacac
tgttgtcacagattagtagttggccttaaattatgtgcccaatatctaaaaagtgacaca
gctatgacagcctaataatgatggccaagcatttattaaactggggacatctctgtgaag
aactgtaggtatacatacaattttaaccctattttttacattttcctacacacacacaaaa
tctttcatcaatatggtctaggttttgtgccttcttttttgatgattacataagatgtt
aaaagaagtttctggccgggtgtgacggctcacgcctgtaatatgagcactttgggagg
ctgaggctggtgaatcacctgaggtcaggagttcaagaccagcctggccaacatggtgaa
accccatctctactaaaaatacaaaaaatcagttgggcgtggtgaagggcgcctgtaatc TABLE 5-continued ccagctacttgggaagctgaggcaagagaactgcttaaacccggggaggtggaggttgcag
tgagctgagattgtgccactgcactctctgggtttgttttctttttttttaaatttatga
cattttatttttattttcaagagttaattttctcacga >IGR1176a
tacaaaaaatcagttgggcgtggtgaagggcgcctgtaatcccagctacttgggaagctg
aggcaagagaactgcttaaacccggggaggtggaggttgcagtgagctgagattgtgccac
tgcactctctgggtttgttttctttttttttaaatttatgacattttatttttttatttttc
aagagttaattttctcacgattcacaaggttttttaaaattattttcaatagataaatc
ataattgcaaacatttatggggtacaatgtgatgttctgatatatgtacacaatgcacaa
tgattaaataaaggtaatttaacatatccattaccttgcctgcctatcatttttttataga
cagacatttgaaatttactctttggatttctgttttttcagaaactcaattcacctattt
ttagacaacattccttttctaaggggattgtgtgtaaaaaggctcacacagatatggtac
tgaaaaaaacctgtgggagaaataccaattgagtttgcatttaaatgaggtgctataata
aatgaatctgagtcagtactagacaaaatgataaacaggtacattttcagctgagatctc
agtcatgatgttaggtttatattagatactggcgaatttgaggctttaaatgaaaatatt
tcccgcaaagaagataagcaagatatggctccccactacc >IGR1177a
aaataccaattgagtttgcatttaaatgaggtgctataataaatgaatctgagtcagtac
tagacaaaatgataaacaggtacattttcagctgagatctcagtcatgatgttaggttta
tattagatactggcgaatttgaggctttaaatgaaaatatttcccgcaaagaagataagc
aagatatggctccccactacctctctgagctcatcttccacaacttttcccttttggcctt
caggtcaaatatgtctcagagattttgcactgcctagaatattcttcttatggacaactg
catggctgactccctcacttctctcaagtttccactccactgccacctttcatcaagtccc
ctcctaccacccttcagctagtccctattcccttatcttgctgtagttttctcaatgccc
ctgatcatcccctggcatattatatatttacttatttgtcatccatctcctccccactgg
gatataaactccatgagggcagggactttgtccattttgtttactgctgtattacctgca
ctccagtagactgcctatattggttgcatgaatagacagttctcatgatagtggtggcat
caagggcatattctaaaggtgaaaaagcaaatggtgcacagataaatttaatcttgttac
tttaccccctcttcaccaataaccttccacctaagtgacta >IGR1178a
cagggactttgtccatttttgttttactgctgtattacctgcactccagtagactgcctata
ttggttgcatgaatagacagttctcatgatagtggtggcatcaagggcatattctaaagg
tgaaaaagcaaatggtgcacagataaatttaatcttgttactttaccccctcttcaccaat
aaccttccacctaagtgactatcataaatagacctccacaatgtctctgaaagtgaccc
acgggatatttgaaagtagtatcctaaccagaggtggaaggaagcttaatgatcatgtaa
atcaatcccctcactttacgtgggggatacgaaggcccaaatgggttaagtaacatccct
aaggtcacccagcagagttggaatttgaagtcaacctgactgcactcttaggcaattgct
ttcccatatttaaaaaaaaaaaagtcctcttggttgggcatggtggcttagtgcctgtaa
tcctagcactttgggaggctgaggtaggaggattgcttgagcttaggagttcgaggcttc
gatgagctataatcaatcacaccactacactccagcctgggtgacaggagcaagaccctca
tctatcaatcaatcaagtcctcttaattcattattgacctttcatttgtggatttattta
aacttaaaaaaagtgttttataatgttatttcctactatt >IGR1179a
tgaggtaggaggattgcttgagcttaggagttcgaggcttcgatgagctataatcaatca
caccactacactccagcctgggtgacaggagcaagaccctatctatcaatcaatcaagtc
ctcttaattcattattgacctttcatttgtggatttatttaaacttaaaaaaagtgtttt
ataatgttatttcctactattgggaagaagacttcctctctcatttgtcccaaactcatc
cttctccagttttccagaatggcccactgacattctgttagagcttgctaaacaaacagg
ggttcatctttccctgctcttcgggtcttcaagttttggttctttataaaaatggttt
cctcacacatgtgtcctcacttagcagccctgccagcatcttggtccattttcagtgctt
cctgtaggcctttctagcttcaggttctcttaaaatgtgtggtaaccagccatttacct
ggctaacctagctgagcccagtcatcccatgaaaccatgaaaaactaatcactgcgagac
agttttgaggggtttgttacaagcaatcaataacgggaatagacactacagttctcatt
cattcagcaaatagttatcaaagttacaatatagaatatacaaatgtgtggttgcctagt
ctctaggtaaccagaatggcacacagatgctactgcagat >IGR1180a
agtcatcccatgaaaccatgaaaaactaatcactgcgagacagttttgaggggtttgtt
acaagcaatcaataacgggaatagacactacagttctcattcattcagcaaatagttatc
aaagttacaatatagaatatacaaatgtgtggttgcctagtctctaggtaaccagaatgg
cacacagatgctactgcagatatagggttaggcagattcaagtcagccacaagtacttcg
acactcttcccatcaagagatacagtatcctccctcactgaatcttgggagtttctgtga
ccactctaaccaacagaaaagaagtgtcaccatgccagtttcttggtctaggccttaaa
ggacttgcagcttctacttcctgttcatggaatacttacccttaggatactctgtttagt
aacccagtcactgtgctgccaaaagcccaagacgcatgcagaggccatgtgaagatgtcc
tattttgacagccccagctgagctcccagacaatagtgagcatcactgtcagtcatgtga
gccatcaagaacatccagctcggttatgctttgagacgactgcagccaacatctgactgc
aaccgtaagacccaagtgaaagccacctagctgagcccagtcataccacagaaccatga
aaaattattgtgagacagatttgaggtttgttacatagca >IGR1181a
gagctcccagacaatagtgagcatcactgtcagtcatgtgagccatcaagaacatccagc
tcggttatgctttgagacgactgcagccaacatctgactgcaaccgtaagacccaagtg
aaagccacctagctgagcccagtcataccacagaaccatgaaaaattattgtgagacaga
tttgaggtttgttacatagcaataaataattggaacagacattacagttctcattcattt TABLE 5-continued agcaaatagttatcaaagttgcaatatacaaggaactgtggagatacaacgagtaagaca
tgcaccttactcttagaggggaaactgtggcccagcacggtggctcacgcctgtaatccc
agcactttgggaggctgaggcaggcgattgcctgaggtgaggagtttgaaaccagtctgg
ccaacatggtgaaaccctctctctactaaaaatacaaaaaaaattagccgaagcctggtga
cgtgcgcctgtaatcccagctacttgggaggctgaggcaggggaattgcttgaaccgggg
aggtggagattgcagtgagccaagactgcgccactgtactccagcctgggcgacaaagca
aaactctgtctcaaaaaaaaaaaaggagccgtgatagctagggtcctaaaatataata
cgatgttaatttctgccatttattgtataacagtctaaca >IGR1182a
ctacttgggaggctgaggcaggggaattgcttgaaccggggaggtggagattgcagtgag
ccaagactgcgccactgtactccagcctgggcgacaaagcaaaactctgtctcaaaaaaa
aaaaaaaggagccgtgatagctagggtcctaaaatataatacgatgttaatttctgccat
ttattgtataacagtctaaacacagaactaagctcatatttctactacgtgtactttctac
caatttcaaattttatccatttgatcttttttctttcaagatactaccttattcctctcc
ttccttttattctcaaactactgcctctgtctcctcatctcgtgggccccaataatctg
gttttcacccttgatgcttgtgttggttatctattgttgcataacaaagtatcccaaaac
ttagcagcttaaaataacagcacttattatttctcagagatatgaggatcaagagatacg
cttctgactcagggtctcgcatgaagtcgcaatcaagctgtcagccaggactgcagtcat
cttaaggcttgactgctacaaagtctgcttccaaactcacttgctcaaaggcctcaggtc
cttggcatatgggcctctcagagggctgcttgcaacatggcagctagcttccctcagac
aagagacagagggagacagagtgagtgagagaggggagga >IGR1183a
catgaagtcgcaatcaagctgtcagccaggactgcagtcatcttaaggcttgactgctac
aaagtctgcttccaaactcacttgctcaaaggcctcaggtccttggcatatgggcctctc
cagagggctgcttgcaacatggcagctagcttccctcagacaagagacagagggagacag
agtgagtgagagaggggaggagtgggggagagtgagcgagttcacacaagggtacaagca
cattgcgagaacagaagaagccatagtaccttaaataacctaatgttggaaaggccatgc
tatcacttctgcctgttttatcagttatatagaccaatcatgcaacagcatgagatggga
ctatacaagagtataaataccaagaggccgagattactagggaccatcttagaagttggc
tgccacaaaccacatcttcttaggcctttctttctccttttcctgaaactcctccttggt
tttccaggacaatcactttcactctcctggttttctgcttcgggcttctcagcct
gtttcagtcaatatattaatattagattaattttcctaaaatacatctttcactaactcc
cttaggttggctcctcatcacctatcagagttacaactagacctgaatataatgtagccc
tatctccccaacatacaggactcaatccctataaataatt >IGR1184a
cactctcctggttttttctgcttcctgagcttttctcagcctgtttcagtcaatatattaa
tattagattaattttcctaaaatacatctttcactaactcccttaggttggctcctcatc
acctatcagagttacaactagacctgaatataatgtagccctatctccccaacatacagg
actcaatccctataaataattcccaaactccagataacatttctactgcagcataggtc
atactcctcttccctttgcaccgtgttctgacttccgtctcctctcagttgagctgaatg
aacttctccaggtcttatattcctcttcctgcctcattctcaaaatattcttctcattct
gtatccattggctcctcccttcttacctaacacatctgtttgaatcatttttttaagcact
ttattaagcctagctttctaaatgttgaattctgagagcttgtcttcttaatcagaccat
tagctcctggagggtcatgtcttaggtctctggcactagccttgttctctatgttctggg
agacactaaggcaatcatcacatatttcctgacttgatttttgtttgtaaacagaacata
acacgaatttcttgtataagtgatggaaaatataaacaaccgaaaatcatctatgattca
ttcttttagcaagtggaaaagacattaaaaacatagttta >IGR1185a
tcttaggtctctggcactagccttgttctctatgttctgggagacactaaggcaatcatc
acatatttcctgacttgatttttgtttgtaaacagaacataacacgaatttcttgtataa
gtgatggaaaatataaacaaccgaaaatcatctatgattcattcttttagcaagtggaaa
agacattaaaaacatagtttaaaatctgtcttctgggagaacttttcaatacttaaattc
ttttgctgggttcagaaagtggcatgtcaacagacagtcctaaatctgtgaaaatctatg
cccacaagctaagtcttgggaattaaacacacatacaaaagaacgtaaagactgtgtcta
cctcatagtttaagaaataagcttactggctatgcacggtgctcacacctgtgatcccag
cactttgggaggccgaggtgggccaatcacttgaggccaggagctcgagattagcctgg
ccaacatggtgaaactccatctctactaaaaattacaaaaattagctgggcgtggtggta
catgcctgtaatcccagctactgaagaggctgaggcatgggaatcgcttctgggaggtgg
aggttgcaatgagccaagatcatgccactgcactccagcttaggtgacagagagagactc
tgtctcagaaaaaaaagaaaaagaaaaaaagacaggaa >IGR1186a
tctctactaaaaattacaaaaattagctgggcgtggtggtacatgcctgtaatcccagct
actgaagaggctgaggcatgggaatcgcttctgggaggtggaggttgcaatgagccaaga
tcatgccactgcactccagcttaggtgacagagagagactctgtctcagaaaaaaaaag
aaaagaaaaaaagacaggaaacaagcttatctttaaacaaataattgaatcttccttat
catagaagtgatataagacagggcataccagctcagagtccttactgagtaactaccatc
tgcccaggcatgagatgggtacctttacaatgtgctgctacatgtacagtgaaggtaaa
tcccattcttacctcatgggcacaagtcccagcatttcatcacgccgcttttcctttttt
tttagctctgattctgttgacttgagtttatctggagcaagtcgcagtttagactgcaaa
tcactgatgacttcttgtaactcagcctctgtctgaaaaactctctgacaaacggggcaa
catgactggttttcgtctgttagctgagtaatgaactgggagtaaactgctgtggctcca
gccagcatggctattttaagaaaataaattatatcaccaatgagaaaaaaacataaaata
cagtattctgaatacggttgtatctttttctataaatata TABLE 5-continued >IGR1187a
actcagcctctgtctgaaaaactctctgacaaacggggcaacatgactggttttcgtctg
ttagctgagtaatgaactgggagtaaactgctgtggctccagccagcatggctattttaa
gaaaataaattatatcaccaatgagaaaaaaacataaaatacagtattctgaatacggtt
gtatctttttctataaatatatgattattcttgctttataaatatattataaaagaaata
aaaattctgatatttaaaattccgatattcgcttccaaagagcatgatacattcagattt
gtataaatatttttggtaacacattataagtataacaaaatgcctactgagagctttct
atgtgccaggcactgttctaagggctttataattacaatctcattcacacctcagtacca
caggtggtagttgtgtcctcattttatagacaatgaaacacaggaaggtttcagtaactt
gcctaaagtcacacagtgagtaagttgtagagccaggactgaaatccaagccattaggct
ccataaccaggttttaaattcccatccttaacagttacctgtgaatgaaaattcaaag
gtgtcaaagtatcctgataatataaagtagacaacttacctcgctgttttgatgattttt
caatttcctctttaagcctgtctaaatcactttcaaaatc >IGR1188a
gtaagttgtagagccaggactgaaatccaagccattaggctccataaccaggttttaaa
ttccccatccttaacagttacctgtgaatgaaaattcaaaggtgtcaaagtatcctgata
atataaagtagacaacttacctcgctgttttgatgattttcaatttcctctttaagcct
gtctaaatcactttcaaaatcctggctaccacaaacatcaaacagcttgtcttcgtaact
ggacaactgctcttcctttcttttagttcattatttatatgatttttattctgctcaga
tgaagctagttccttgctaaaataagagcaaatatggattttcattttaaaataggagaa
attagtttgaaatttgagtaggcaaaaacaagacaaattctgccaacaaatcatgacaa
gagtttggtatgaccaaataatttttttcagaagttgagggactagtccacttctgcctt
aactctcccctaggacactgactcacctgccagtcctactcatgggcctgctcccagaa
aaatgtacacagaattctgcctggtttctggggttcatggtctttgatcccaggttaag
cctcagcaagatgcttgctaggactattggacagaaagaagacaagagaacatccccgta
attccctttagtcctttcacaaatactacttccttactct >IGR1189a
tgactcacctgccagtcctactcatgggcctgctcccagaaaaatgtacacagaattctg
cctggtttctggggttcatggtctttgatcccaggttaagcctcagcaagatgcttgct
aggactattggacagaaagaagacaagagaacatccccgtaattccctttagtccttca
caaatactacttccttactctcctgtaaatactgtttcttttgtatcctcccctccttg
ttgctgtcatccacttgcgtccagatcagtcattccctctcattcatcaaagattttgct
tactagtacaatttatccccactttaattcttaaacatcatcctagccaacctcaatact
cacacataacatggttttcaatttgcaggtttagatgcattagctaccatgtaatcaat
ttaatgtattcagcatatttttaaaaatgaaacagaatagacggtaatatattggagta
ggctgtatgtatatgtactactttgagaaatttgtttcagataaatgtgtgtgactgcac
acatgcttcttcatcatgactacccatcctgagtcacagtaaacatttggaaaaaagtaa
ctaatatgatgatttcattatcctagactcccttgagcacttctcatcaagatcacc
agtgacctaagtgccaagtacagtcttcatcttactctac >IGR1190a
actttgagaaatttgtttcagataaatgtgtgtgactgcacacatgcttcttcatcatga
ctacccatcctgagtcacagtaaacatttggaaaaaagtaactaatatgatgatattttc
attatcctagactcccttgagcacttctcatcaagatcaccagtgacctaagtgccaagt
acagtcttcatcttactctacctctacgtagcaccaaacactgttgaccttctccttgaa
gactattttcccaaggcacctagacaccacagctatctggctctcaccctggttccctgg
gcacatcccagtttccttcacttgctcctttttcctttgcctgctaacattttaaatgttt
gtgcttcccaggaatctaattgtaactccttcccttttgcataactctctcaaggtgcat
actaatgactttgagtatcccttacatagcaacaacttccaatctcctgaatttcaaact
ccaatattgtattccctcacagatacttccacaagaaacacagattaaacaccaccaaag
ccaagtccttctactttcctcaaaaatctgtgtggaatttttgacccgcttatccaacca
ctatccaaggtaacatctgagaaacatgatcacttttataatggattactcacagaaat
gaaaatagaatttttaaattttaatcttcataggtctaca >IGR1191a
cagatacttccacaagaaacacagattaaacaccaccaaagccaagtccttctactttcc
tcaaaaatctgtgtggaatttttgacccgcttatccaaccactatccaaggtaacatctg
agaaacatgatcacttttataatggattactcacagaaatgaaaatagaatttttaaat
tttaatcttcataggtctacaaattttcaagggacaagaggcctaaattactatccgtta
ccattttacttaatttgcaaaatatgagggtcttcaaaatgttcatggaaaatgtgtat
tataaaaaaactatgcatgaagttcaaaatgttttgcactgaaacaaactcatactaac
ttgttataacatgtctgaataggatctagtttaaggcactaacaaggttaagacatcagt
ttgaaaagagccccaattaaactgaagcaagaacaagtatcaaatttatggtgaagtgtg
ggtggaagaatggtgaaatcattgatactttacaacaagtttatggatcaatgcccaa
acaaatcagcagtttacaaatggataactcagtttaagaagggatgagacgatattaaag
atgaagcccacagtgacagactgttcacatcaatttgtgaggaaaaaaaatcatcttctt
catgccctaactgaagaagatcaatgattaacagcagaaa >IGR1192a
cattgatactttacaacaagtttatgagatcaatgccccaaacaaatcagcagtttacaa
atggataactcagtttaagaagggatgagacgatattaaagatgaagcccacagtgacag
actgttcacatcaatttgtgaggaaaaaaaatcatcttcttcatgccctaactgaagaag
atcaatgattaacagcagaaacaatagccaacaccatagacacctcaattgattcaggtt
acacaattctgactgaaaaattaaagttgagtaaacgttctacttgatggatgcccaaaa
tcactgcttccagatcagctgcagacaacagcagaacttcctcaataagtgggatcaagt
tcctaaagcatttcttcaaagaattgtaacaggagggtgatggaatgtggctttaccagta
caatcctgaagacaaagcacaatgaaagcaatggctaacaagtggtggaagtggtccagt

TABLE 5-continued caaagcaaaagcagaccagataagagcaaggtcatggcaacagttgttggggatgctca
aggcattttgcttgctgactttctggagggccgaagaaaggtaacaactgcttattatga
gagtgttctgagaaagctagccaaagcattagcagaaaaatgcccaggaaagcttcacca
gagagtccttttccaccacaacaatgttcctgctcattcc >IGR1193a
ataagagcaaaggtcatggcaacagttgttggggatgctcaaggcattttgcttgctgac
tttctggagggccgaagaaaggtaacaactgcttattatgagagtgttctgagaaagcta
gccaaagcattagcagaaaaatgcccaggaaagcttcaccagagagtccttttccaccac
aacaatgttcctgctcattcctctcatcaaacaagggccatttgcaagagtttcgatggg
aaatcattaggcatccaccttacagtcctgatttggctcctcctgtcttctagtttctta
atcttaaaaaaatcttttaaagggcacccattttatgctagcaatgtaaaaaagactaca
ctgacatggttaaattcccaggaccctcagttctttaggactgaactaaattgctggtat
cactgctcagaagagtcttgaacttgatggagcttatgttgagaaatacagtttatttaa
aattttatcttttaattccattttttccatgaactttctgaagtctccttgtatgtaaga
actaaagtttatcaatataacataccatttcatgacaataaattatttttaaaacaattaa
acaggtaagcatgaaataagagatttctattacatctccaaatgttgcaacttacttcaa
tttggcaagtctgtccctggtctgattaatttcttttgat >IGR1194a
catttttccatgaactttctgaagtctccttgtatgtaagaactaaagtttatcaatata
acataccatttcatgacaataaattattttaaaacaattaaacaggtaagcatgaaataa
gagatttctattacatctccaaatgttgcaacttacttcaatttggcaagtctgtccctg
gtctgattaatttcttttgatttactatgtagccagtcttcaagctgttttttgttggga
aaatatcccaacagtgaggttaattcatcactgtgcctagattttattttctgatttgt
tcatctttgtcagcctataggtaaaaaaaaatcttttaaaaataaagtctatatctcca
cattatatcaagaacaaaaataaattctagactgactaaagttctaagcttaaaactata
aaaatatgaaaataaaatataaaatttcttaaagttcttaaagtcttcaagtggggatgg
tctttctaagccttaagagtggagtaccaagtcgaacaataaaaatttaaaatttgtg
tatgttaaaagttaacagtaatgtgcatgtgtgtatatacatatatatacatttctgtat
taacttttgtaattaaacaataacttttaagcttgaaagtctattatatagagtactaa
gctcacttagcctctaaaatatagtcaataccaacttaat >IGR1195a
tggagtaccaagtcgaacaatataaaattttaaaatttgtgtatgttaaaagttaacagt
aatgtgcatgtgtgtatatacatatatatacatttctgtattaacttttgtaattaaac
aatacttttaagcttgaaagtctattatatagagtactaagctcacttagcctctaaaa
tatagtcaataccaacttaatacctatagtctatgacttatgagtgcaaggtaggctat
tttaagtaccagacagtataattagaacaaaagaaaaatcatactttgtctttggtcag
catctccatttgggtacgtgttgttgtatgatggtttaactgctccatctcctggtcaag
tttacgcagggtcctgtctaagtctgcttttttcattttggagacttattacttccatttt
taaggtttctacattgctgtttttctcagccttgcttaactcacgttcctagtcaataat
tcatacaaatgcaaaggtgttatatattttgtgcaagaattaaaataatgacaaagtgta
ttagaaattaactactcctcagaatgttccaaatattactgtttgcatccaacaagagaa
aaaaacataaggcactatatatgctctaaggtatatcttattaaagtgaccttactatgt
tataatggtagagaattagtaaataaacctagaagggtca >IGR1196a
ttatatattttgtgcaagaattaaaataatgacaaagtgtattagaaattaactactcct
cagaatgttccaaatattactgtttgcatccaacaagagaaaaaaacataaggcactata
tatgctctaaggtatatcttattaaagtgaccttactatgttataatggtagagaattag
taaataaacctagaagggtcaaacaggaaagaaatgtgagaattactgtaaaattaggag
acatgtgtctaagtacacagattagtgagtcctcagtcaacaattaaatatttattatgt
ccccatgtaattcactatattgcctggtatgtagaaactataaaaatagtgatgtggt
ccctgaccaagtatctccccaccccaacaagacaacactgatgaagtgctaaactgacaa
aaatgtatgctacaatggtgagttatggagcaaaaataaatgtttacataaattatcaag
atgggctttaagaagtttgccatgcttagaatgcttactttggtaatggagatgtgaag
aaggaggacagactagaagcaagaaagaaaatatggaaataacctgaaaagattggctaag
aaagttttttaacacagaaaagtaataatacagcaaaaatcatctagaattacaacgtgt
gtgacctagaggaaaaatacttgcttttttaaaactttgg >IGR1197a
ccatgctttagaatgcttactttggtaatggagatgtgaagaaggaggacagactagaag
caagaaagaaaatatggaaatacctgaaaagattggctaagaaagttttttaacacagaaa
aagtaataatacagcaaaaatcatctagaattacaacgtgtgtgacctagaggaaaaata
cttgctttttttaaaactttggcaagtgttcttttttctttttttgagatggagtcccact
ctgtcacccaggctggagagcagtggcgcaatcttggctcactgcaacctctgcctccca
ggttcaagcgattctcctgccctggcctcccaagtagctgggattacaggcacacgccac
cacgcccagctaattttttgtattttttagtagagacggggtttcaccatgttggctggaca
ggtcttgaactcctgacctcacgttatctgcctgcctggcttcccaaagtgctgggatt
acaggtgtgagacaccgcaccggcctggtaagtgttcttaatcaaggtgctcataagaa
ttagccagttttgttgtgttttgaatgtacatttctatgccccattctcagagatttga
tttgaaggtctgaagcttaaggtctgagtacagtatctttaaaaagctccctatgtga
ttctaattttcaggctatcgggttgtagaaccaaagagtc >IGR1198a
cccggcctggtaagtgttcttaatcaaggtgctcataagaattagccagttttgttgtgt
tttgaatgtacatttctatgccccattctcagagatttgatttggaaggtctgaagctt
taaggtctgagtacagtatctttaaaaagctccctatgtgattctaattttcaggctatc TABLE 5-continued gggttgtagaaccaaagagtcagaagatcaagatattcagatgaattcattttacatgag
aataagacaaagttgatgtttttattaaaatgctataatcttaggatcaaaaatagacaa
aatacttctaaaagtattatatcttaaaattattagattattcaaacaatatcttacagc
ttttatgagctcctggtccagttcaagaatcctgtctgaagatccttccaactgctgtaa
ttcatacttcacatttttcagctcattctgcttcttacttaggatttctgattttaactc
aattattcttcccagtccagttttcttatctcttatctcatctatctgttttgtttcag
agtctcttttctgcaaagtcattctaaatgcatatgtaaagaatgagcattaataattt
actaaacaatttaagttttttaattgcaaaaggaatatatgtacactgaagaaaatacaa
aaaagtacagtcgtgtgttgctcagcagggatatattcca >IGR1199a
gttttcttatctcuatctcatctatctgtttttgtttcagagtctcttttctgcaaag
tcattctaaatgcatatgtaaagaatgagcattaataatttactaaacaatttaagtttt
ttaattgcaaaaggaatatatgtacactgaagaaaatacaaaaagtacagtcgtgtgtt
gctcagcagggatatattccaagaaatgcatcattaggcaattttatcattgtgtgaaca
tcagaatgtatttacataagcctacatggtatagtttaatacacacatagactatatggt
atagcctattgtttatgggctacaaacctatacagcatattactgtactgaatactttgg
caactgtaacatgatgataagtatttatgtatctaaacatatctaaacacagaaaacata
cagtaaaatacagtattataatttatgggaccaatgtcaaatatgtggtctatcactga
ccaaaacatgtggttcaagactgtattttaaaaacaatcaaaaccattacccagagataa
tcattaactgtgagcaaatgttttctctgcaattagtttttaaaaattttacttaaaac
caaataaaaaatgtaggtttacatttttcttcatatttttatctttatacacttaagaaca
tttgcttcaataaaggttttttctgccttgtagcagattttt >IGR1200a
actgtattttaaaaacaatcaaaaccattacccagagataatcattaactgtgagcaaat
gttttctctgcaattagtttttaaaaattttacttaaaaccaaataaaaaatgtaggtt
tacatttttcttcatatttttatctttatacacttaagaacatttgcttcaataaaggttt
ttctgccttgtagcagattttatcctaacactaatagaaaaatatgccaaaatggagtcc
aaccaaaaattaaaacaattcaagtagagaatatgatgcaaacaaaataacaaatactgt
atttcaaaatacttgccatcagttggttggcagtttttgcttcccttcttgtctctctc
tcacaagtttgtgaaaattttaatctgtctttcactgaatggtccacgctcaaagccat
ccaattctagctgtgttgccaaagactgaattaatgaatctctagctcggatatgttctt
gatggcgatctgcttgcagctgtagacgaccttttaaaaaaaaaatctcataatttttt
ttcaactggtgcttaaaaagttgagatagctgcagattcacgagttataaaaaataatgc
agtgtgtctcttgtacatttttgcccagtttctcccaatgataacattttgcaaaactgca
gtaaaatatcacaaccagaatactgatattgatataattc >IGR1201a
ctgtagacgaccttttaaaaaaaaaatctcataatttttttttcaactggtgcttaaaaa
gttgagatagctgcagattcacgagttataaaaaataatgcagtgtgtctcttgtacatt
ttgcccagtttctcccaatgataacattttgcaaaactgcagtaaaatatcacaaccaga
atactgatattgatataattcatcaatcttattcaaatttccccaatttatttgtaccc
ctgagcatgtggatgtgtatattaagttctatataattttatcacctgtgtcggttca
tatatccactatggcagtcaagatactgaacagttccaatactacaaggactctcttttt
gttctaatcataaccatacctagctccctcctgtcctttctcttacccagtatccctggc
aaccactaatttctccactatttctaaaattttgacattataaaaatgttatataaatgg
aaacatactgtgtatagccttttaagattggcttttcactcagcataagtccttggagat
tcttcattcatacagaaaatgtataacatcatagtaggaaaaacgaccaaataaacatttt
tgtcctaccctgttcaacaagcagttctgattttcctgattgagaagcctagattcttt
atttagtttttccagttcacgatgacagtctaccaatttc >IGR1202a
ttttaagattggcttttcactcagcataagtccttggagattcttcattcatacagaaaa
tgtataacatcatagtaggaaaaacgaccaaataaacattttgtcctaccctgttcaaca
agcagttctgattttcctgattgagaagcctagattctttatttagtttttccagttca
cgatgacagtctaccaatttcctttctttctcccttactgttctctggtgattgtgatat
aagtcatttagttgctcatcagtcccttgaaaaacctgtgtaacaccaaaataaaaagct
ttaatgtacaaacataagaaaatatgatcactttgaggtatcaaatataaaccaaaccttt
attcaatatccttcattttaacatatacatagaagtaacaagatctgtatttgtttttt
ccaatgtggatggcaaaatggattcaaataaagttcattacaataatcccaaaattttga
agcagaacaaaattctaccaccacaaaacctttccatttttctcttccagttcactattat
ctttctccatttgcttcttcggctatccaaggctttaatttcattgtcaagtttcatta
ttttagagagattatgttcaatttctttttagacgattctgaaaataaagaaacattacat
aaataaaactcactatagcttacatggctgatagatgaag >IGR1203a
accacaaaccttttccattttctcttccagttcactattatctttctccatttgcttctt
tcggctatccaaggctttaatttcattgtcaagtttcattattttagagagattatgttc
aatttcttttagacgattctgaaaataaagaaacattacataaataaaactcactatagc
ttacatggctgatagatgaagacaagtaagatactccaggtccaggcatttagtaaaagt
gatctcatttaaggctaacaataacactgtagagcaggcctagagaaactgaagttcaga
gacattaagtaacttggcccaagtcctcacagctagtagagagaagcaggaattaaattc
cacttctaactccaaacaccatgtcctgtcctcaacacctgccacaaaagtcattattca
ttcattgggcatttagagttacttaatccttaaaaaggtaactatttaatgtattttttt
aagtcaggactactgagaaggctagaaattcatggtgagttaccaatgcattctgagcct
ataggcaaatttacatgaagagtatactttaatccaaagcttgctcaaccacagaggact
ctgagcaagtaaagtacaacaagggagctcagtggcctgctctgaggctcgcttccagag
acagctggttgcctcatctcccaggaatactgggatctgg

TABLE 5-continued

>IGR1204a
ggctagaaattcatggtgagttaccaatgcattctgagcctataggcaaatttacatgaa
gagtatactttaatccaaagcttgctcaaccacagaggactctgagcaagtaaagtacaa
caagggagctcagtggcctgctctgaggctcgcttccagagacagctggttgcctcatct
cccaggaatactgggatctggttcggggcattctcttattggatgatgctggggatattc
ttctagtgtttgcctctatgattccaaaactgaccaactcttcttctaagacatttttac
aacctactttttattattattatttcaaatgcagagacaaggtcttgctatgttgccctgg
ctggagtggctattcacaggtgcaataacagtgcaatacaacttgaactcctgggctcaa
gtgttcctcccacctcagcctccaagtagctgagactataagtatgtaccaccatgccca
gcagaacctaattttaaactaacatatgaagttattggaatgcttagacagcaattgcaa
gctttcataattgcaccaaaatgcatcctcgactttaacataatttattaaaattatact
aatagtatagcttgtgatttgtatatgaacgtaaacgttcatatacaaatgaacctaaaa
acagaaactttgtttactttgttccctaatgtatccccag >IGR1205a
taacatatgaagttattggaatgcttagacagcaattgcaagctttcataattgcaccaa
aatgcatcctcgactttaacataatttattaaaattatactaatagtatagcttgtgatt
tgtatatgaacgtaaacgttcatatacaaatgaacctaaaaacagaaactttgtttactt
tgttccctaatgtatcccagaacatgcaataggtgttcaatgttagctaaacgaaagag
agatttgaaaaaataattttaccaagagcaacagtcacaggtatcactgattgaatgtc
tgctatgttccagacactgtactaggtgctgctataaattctctctaatcctcacaaaag
tatatactaagcaggaaattcaaaggacttaactgacttgtacaaaattgtatagttaag
attgggagacaagataacaataagattagaaggcagggtatcataatgactaggctctgg
gtgctagaaagaagtggacatttgtatgtaagaaagtaaacctcaactttttacctcatatc
atattaagattctgaaatgaagcatatacttaattgtaagaactcaaactataaaacttt
tagaggaaaacactgaagaatattttttgtgacactgggtcaaagacttcctaaataataa
acaaaaagtataaaccataagagaaaaaagtttataaact >IG1206a
tttgtatgtaagaaagtaaacctcaacttttacctcatatcatattaagattctgaaatg
aagcatatacttaattgtaagaactcaaactataaaacttttagaggaaaacactgaaga
atattttgtgacactgggtcaaagacttcctaaataataaacaaaaagtataaaccata
agagaaaaaagtttataaactgtacctgatcaaaatttaaaactcctgtcctctgaaaag
cagttaagaaatatctgcaaaaccaatatctgataaagggcttgtatccagaacatattt
agaactctctgcctggcactgtagctcacacctgtaatcccagcactttgggagactgag
gcaggctgattgcttgagcccagaagtttgagaccagcctgggtaacctggtgagaccttt
gcctctacaagtctcaccggtgtggtgagtgtgtgcctgtagtcccagctacgtgggaga
ctgaggtggaaggatcacttgagcctgggagtcagaggttgcagtgagccaagatcacac
cactgcactctggcctgggtaagacagcgagaccctgtctcaaaaaacaagaaaaaaaaa
aaaaaaaaaaagaactctcacagctcaataataaaatgaccaataaataaataacattga
aaaataggcaaaagacttttatattttactaacgaagata >IGR1207a
tgagcctgggagtcagaggttgcagtgagccaagatcacaccactgcactctggcctggg
taagacagcgagaccctgtctcaaaaaacaagaaaaaaaaaaaaaaaaaaaagaactctc
acagctcaataataaaatgaccaataaataaataacattgaaaaataggcaaaagacttt
tatattttactaacgaagatattcaggtggcaaataaatacatgaaaagatgctcaaaat
caataatcaattgactgatcaactaggaaaacacaaattaaaaatataaagaaatacaac
ctcacaatgtcacaatgagacactaccacacccctactgttatggctaaaatgaaaaaga
ctgacagtactaagtggggatgagaatgcagagcaattacattcccataaattgttggta
tattgttggtaggactatgaagtggtaccagatggtacagccatctggtaacttataagg
ttaaacatatatttaccacacgacctagcaacccgagtcctaaagttatccaaagacctg
tatacagaagtttatagcagtttatctgtaacaacccaaagccgaaaacaacttatttc
ttttttattatactttaagttcgagggtacatgtgcacaacatgcaggtttgttacatatg
tatacatgtgccatgttggtgtgctgcacccattaactcg >IGR1208a
acgacctagcaacccgagtcctaaagttatccaaagacctgtatacagaagtttatagca
gttttatctgtaacaacccaaagccgaaaacaacttatttctttttattatactttaagt
tcgagggtacatgtgcacaacatgcaggtttgttacatatgtatacatgtgccatgttgg
tgtgctgcacccattaactcgtcatttacattaggtgtatctcctaatgctatccctcct
cccctcccccaccccacaacaggacccagtgtgtgatgttccccttcctgtgtctgtcca
agtgttctcattgttcaattcccacctatgagtgagaacatgcggtgtttggttttttgt
tcttgcggtagtttgctgagaatgatggtttccagcttcatccatgtccctacaaaggac
atgaactcatcatttttatggctgcatagtattccatggtgtatatgtgccatattttc
ttaatccagtctatcatcattggacatttgggttggttctaagtcttttgctattgtgagt
agtgctgcaataaacatacatgtgcatgtgtctttatagcagcatgatttataatcctttt
gggtatatacccagtaatgggatggctgggtcaaatggtatttctatttctagatccttg
aggaatcgccacactgacaaatgggttctaattaaactaa >IGR1209a
ttggacatttgggttggttctaagtctttgctattgtgagtagtgctgcaataaacatac
atgtgcatgtgtctttatagcagcatgatttataatcctttgggtatatacccagtaatg
ggatggctgggtcaaatggtatttctatttctagatccttgaggaatcgccacactgaca
aatgggttctaattaaactaaagagcttctgcacagcaaaagaaactaccatcagagtga
acaagcaacctacagaatgggagaacatttttgcaatcaactcatctgacaaagggctaa
tatccagaatctacaaagaactcaaacaaatttacaagaaaaaaacaaacaaccccatca
aaaagtgggtgaaggatatgaacagacacttctcaaaagaagagatttatgcagacaaca TABLE 5-continued gacacatgaaaaaatgctcatcatcactggccatcagagaaatgcaaatcaaaaccacaa
tgagatatcatctcacaccagttagaatggcgatcaataaaaatcaggaaacaacaggtg
ctggagaggatgtgagaaagaggaacactttacactgttggagggactgtaaactagt
tcaaccaaaaacaacttaatgtccatcagccacagaatggatgaggaaaaaaattataat
acatgcatacaatggaaggaatgctcctccacaataaaaa >IGR1210a
agttagaatggcgatcaataaaaatcaggaaacaacaggtgctggagaggatgtggagaa
agaggaacactttacactgttggagggactgtaaactagttcaaccaaaaacaacttaa
tgtccatcagccacagaatggatgaggaaaaaaattataatacatgcatacaatggaagg
aatgctcctccacaataaaaaggaatgaattgccgggcacagtggctcacacctgtaatc
ccagcactttgggaggccgaggtgggcagatcatctgaggttgggagttcgagaccagcc
tgaccaacatgagaaaccccgtctctactaaaaatacaaaaaaaattagctgggtatgg
tggcacatgcctgtaatcccagctacttgggaggctgaggtaggagaattgcttgaacct
gggagacggaggttgcagtgagccgagatcatgccattgcactccagcctgggcaataag
agtgaaactccgtctcaaaaaaaaaaaaaaaaaaaaggaatgaattactcacacatgcag
caacatagataaatcccagacacaaaagtctgcatactgtatgattctatatatgtgcca
ctctctggaaaaggcaaaactataatgacagaaaacaaattagtggttactatggatggg
agcaggggagaggactgactgcaaggactttgagagaact >IGR1211a
aaaaaaaaaaaaaaaaaggaatgaattactcacacatgcagcaacatagataaatcccag
acacaaaagtctgcatactgtatgattctatatatgtgccactctctggaaaaggcaaaa
ctataatgacagaaaacaaattagtggttactatggatgggagcaggggagaggactgac
tgcaaggactttgagagaacttttttggagtgactgaaatattctacatctttcattttagt
gatggttatgctactgtatgcatatgtcctaactcatagaatttatactctaaaaagggt
ggatttaccatatatatattataccttaataaacttgacttaaaaagaaaaaaggtat
aaacttaggaatcagaggactcaaatcctacctttaaccctttatttccactgtgaatacc
tgtacctcagttttcctgcctatacaacctcacagttactatgggagtttacattatacat
tttaaagcactcgggttagtgttaggcagtaaacattcaattaatgagaccatttgcacc
acttgtgaaaaaaattctgtactcagaaaataccttttgagtagagtctaacaaatataa
ctggatggatacttaagagcaatgaatactaacagctctactatgatactctacaaagtg
ctcagtttctttccatcagtgttttcactgcctcttggta >IGR1212a
tgttaggcagtaaacattcaattaatgagaccatttgcaccacttgtgaaaaaaattctg
tactcagaaaataccttttgagtagagtctaacaaatataactggatggatacttaagag
caatgaatactaacagctctactatgatactctacaaagtgctcagtttctttccatcag
tgttttcactgcctcttggtagcacaaacattatgataatcatctgggcttggatctttc
atgacatctctacctgcttcattccttaaatccagccagtcaccagatcccctgaattcc
ttctttgacatctgtgttttggttctaatctcagagcacaaaacataggttctatcccca
gagtacacacctagtaaaaggagctaggacaagcaggcagacaacaataacaaaaacagc
caagggtttaaagcttaggtgccagtgtgaaatgagataaaaaaaatagagcagctgggc
tatcaagtatagaaggaccatgaacttgtgtgcagaaaaaaaaaagttagaaacatattcc
tctagcaattcccatttaaggcaagaaaggaaaacagatctaagtaggccaaaaaaagag
gacaggatatggtgggatggtaataaagtagtttatgagagagtgagagttcccgaagat
aaagggaatcagtaaaaatgggaaaggatgcattctagtg >IGR1213a
atgaacttgtgtgcagaaaaaaaaagttagaaacatattcctctagcaattcccatttaa
ggcaagaaaggaaaacagatctaagtaggccaaaaaaagaggacaggatatggtgggatg
gtaataaagtagtttatgagagagtgagagttcccgaagataaagggaatcagtaaaaat
gggaaaggatgcattctagtgcatggttgaaaggacgtagtcttttctgggaaggtgatt
tgacccaaacttttaattgggttctatgaagggaaaatcttcacatgtcagagctaaaaa
aaaggactttggaagtcatctacttaataaacatttattgaaccacctgctatgtgccag
gcactaggctaggctctgaggatacagagaagaatattaaacccttggagaattactcac
aattaaacacaaacaagtaaataaatacctcaacctctgctacagccttggttagaatct
tggcaccactcactaaatcctaggtattatcatttagccctaccttgacatcattttccaa
tataaatgcttcatttcaacaatatggatttccttgacagtgttcaaagacagcttggat
tttactgtctctatgtctccaatgacttactcatttatgatcaaaaaagtcatggccaaa
ttcagtcctatgaaatcctctctggctacctcagatagaa >IGR1214a
ctaggtattatcatttagcccttaccttgacatcatttccaatataaatgcttcatttcaa
caatatggatttccttgacagtgttcaaagacagcttggattttactgtctctatgtctc
caatgacttactcatttatgatcaaaaaagtcatggccaaattcagtcctatgaaatcct
ctctggctacctcagatagaaattctctttctttatcctcagagctcctacaggtcttgt
ttttttctctgccttaccattacatgtgcttgtcatctctccaaccaagatgctcctcaa
gaaaataaaacgtggagtggggcaaggggaagaagaaaaaaaaggaaatctgttcta
atatcttggtaattaccacgggacccacacagagttatcaggacaactcatcctaaaata
taacatagtcttccactcttctgtctattgaactaagtctgaaatccattagctttctat
aatctgaccccgattcatattggtcatttactccttttatattgatttacttaacccaga
ctcttcctctcataatcctgttctgattaagcttgtaaaggtaaatatgcacatacatac
aagtgaatgtttgtatatacatatgtattgtatatatgcagttaaaaaaagttgcaggta
aaatatactctggaaggttagagatgagaaatggaagact >IGR1215a
ttggtcatttactccttttatattgatttacttaacccagactcttcctctcataatcct
gttctgattaagcttgtaaaggtaaatatgcacatacatacaagtgaatgtttgtatata TABLE 5-continued catatgtattgtatatatgcagttaaaaaaagttgcaggtaaaatatactctggaaggtt
agagatgagaaatggaagactatcttttacttttcacctaatatccttttataacttttt
tactagggcacatattacttttaaaagaaaagtcaaaataaatacaaacatttccaggt
gcggtggctcacgcctgtaatcccctgcacttttggaggccgaggcgggcagatcacttga
ggtcgggagttcgcgaccagcctgaccaacatggagaaaccccgtctctactaaaaatac
aaaaaattctatttttttttttatttagccgggcgtggtggctcatgcctgtaatccca
gctaccctggaggctaagtgggagaattgcttgaacccgggaggcagaggttgcagtgag
ccgagatcgtgccactgcactccagcctgggcaacaaaagtgaaactccatctcaaaaat
aaataaataaataaatacaaacatgtataaaatgtcttctagtttgctgacttgatttct
tcccattcttcaaggcccacctcagccctacctcctccca >IGR1216a
gggagaattgcttgaacccgggaggcagaggttgcagtgagccgagatcgtgccactgca
ctccagcctgggcaacaaaagtgaaactccatctcaaaaataaataaataaataaataca
aacatgtataaaatgtcttctagtttgctgacttgatttcttcccattcttcaaggccca
cctcagccctacctcctcccagaagccttgcaatatatttctatgcatggccatcatta
aaaatatatatatatttttctacttcatgattcaaagatctatactggtatttacaggtga
gtttttaaaaaccaaatcaataaattttttaatgactttaaaaaaatctactatctaaaa
catagcaaatagccattttaagaatgctcttatttagactaggaataccttaaggacag
gggtgcagttgtagtcctcttttgtacccaagcacagtatacctggtacaaagaagaca
ccaataaatgcttattaaatgaatgaatgaaattcctgtaggcctttcttataaatcac
cgggttgaggaaggtatactcatttgcaaatatatgaacatgttatggatcaattccaaa
ttctgtgcaattttgaatgcttcaaaaactttctgcaaatttaaaaattctctagaaa
gatgtcaattttaaaaatattaatacagaactgtaaggt >IGR1217a
tgaatgaatggaatttcctgtaggcctttcttataaatcaccgggttgaggaaggtatac
tcatttgcaaatatatgaacatgttatggatcaattccaaattctgtgcaattttgaat
gcttcaaaaactttctgcaaatttaaaaattctctagaaagatgtcaattttaaaaat
attaatacagaactgtaaggttgggtaatgatattgctatttaacacctagtgatctata
ctactaatttagtgtgatgctacaaattgttttctttcaaatccaagctctttcagcaa
tttaaagactaacatagacctaaaacattagctccctgataattcaagaaatatacaagc
cattcagtttcatatacaaataagggagaatgctactatagcaaaaaaaggactaccta
tttagtatacaagaaattaactactgtacatcactgtgactttagttaataacaatatat
aattgctaagagagtagatttaagtgttctcaccataaaaaaattgaagtaatgaacgt
taaatagcttgatttagccagtccacgatgtatacttatatcaaaacatcatgctgtata
ccataaagatatacaattttttgtcaattaaaaataaaatcaagttaccttcaatggatca
agttcattctcataggatttgacaatttccttttgaagatg >IGR1218a
tttaagtgttctcaccataaaaaaattgaagtaatgaacgttaaatagcttgatttagcc
agtccacgatgtatacttatatcaaaacatcatgctgtataccataaagatatacaattt
ttgtcaattaaaaataaaatcaagttaccttcaatggatcaagttcattctcataggatt
tgacaatttccttttgaagatgttaactgggcttccttacttgtaatctgatcacgaatct
cacaagcttttcctttatattgcttcagatatttagttccatttgatattcttttactt
tctgaccttgtgtctgacgtacctgccgaagtgttctaaggctttaatgtatcttttgaa
gatatgaaacaaaaatcaaatttctggcaaagtaaattatggtatatattcatacagtgg
gatatattatgctgtcactaagattacagttacaatgagttttttaataacttgtaaaatgcc
tatgacataatggtaagtgaaaaaaattacatttatactgtcaatcaggtaaataaatat
acgcacagaaagacaagtgaaagaaaatatgcccaatggttgctgctggatgagaggtag
taactgatgacctttctgctttttaaattttttctgttaaaaagaagcatccaaattgca
aacacagttcaataacttaatggactacaaagtctatttta >IGR1219a
aaaaaaattacatttatactgtcaatcaggtaaataaatatacgcacagaaagacaagtg
aaagaaaatatgcccaatggttgctgctggatgagaggtagtaactgatgacctttctgc
tttttaaattttttctgttaaaaagaagcatccaaattgcaaacacagttcaataactta
atggactacaaagtctatttaagggttacaaaccttgttgctgaaaaaatctcatcaaac
ttttgcttcaaagcctttccttcacttaaaggccaattagaatcttcttgatgacagaaa
atgacattatttagcacagccttggaaaccccaagagaactgatcatttctcggtcaatt
tctgcacacttagagctcagactgaccttttcaccatgcctacagaaaatgaaaatcaag
aatatatgtaaaataaccttcagtgtatctattctattgcttaatcaattcatactgtac
ttctttaaaagaataaaaaaaaaggcccttcacctatcccgttagaaatggcttcatcat
gctaaaaagtgtaactcttaaactatttaacggttcacagatgaaaagatatgtaaaaca
aagtagttcaggaaaggaagccagaatttatttttttacatatttggacttttaaatataa
taatttagaatacttagagatactatatagagcattaact >IGR1220a
aaaaggcccttcacctatcccgttagaaatggcttcatcatgctaaaaagtgtaactctt
aaactatttaacggttcacagatgaaaagatatgtaaaacaaagtagttcaggaaaggaa
gccagaatttatttttttacatatttggacttttaaatataataatttagaatacttagag
atactatatagagcattaactgtcttaaaaataagacaaagaataaaacaaaacatga
tgatcaatagcagacaggcaaaggtaagttaaaaaacatcttagaatgggggttctttcttc
agtaacagactgctctggtgagcagaggcaatatctgtctttactgttttttatacattt
caatttgtattttgaaaatattacactgggccaggcacggtggctcatgtctgtaatccc
agcaatttgggaggccgaggtgaatggatcacctgaggtcaggagttcgagaccagccag
actaacatggtgaaaccctgtctctattaaaaatacaaaaaaattagccaggtgtggtgg TABLE 5-continued tgggcacctgtaatcccagctccttgggaggctgaggcaagagaatcacttgaactcggt
gaggttgcagtgagnngagatnnnnncattgcactccagcctgggnnacnagagnganac
tcngtctcaaaaaaaaaaaaaaaaaaaaaaaannnnnagaaa >IGR1221a
gtctctattaaaaatacaaaaaaattagccaggtgtggtggtgggcacctgtaatcccag
ctccttgggaggctgaggcaagagaatcacttgaactcggtgaggttgcagtgagnngag
atnnnnncattgcactccagcctgggnnacnagagnganactcngtctcaaaaaaaaaaa
aaaaaaaaaannnnnagaaaaaaaatnnnatnntgaatntnttaagnnngntttgcaga
gggntnnaatagacacagataaatcaataggttatcacatgaggtcatgtgaaagacaatg
gtagcttggactaggactagaatggtggttgtagagatggaaacagattccagagacatt
tagattaaattcataggtctcagtaatagactggatatggaaggcaaagacatatcaaga
cttaggttcttggcttttgtcactggacggatagtggtatcattcaccaaggtgaggtat
accataagaccaagttgttggaggttttttaagggggaggtcaaagagaaaggactgag
tttggttttggaaacgttgaacctaagttgtctttgaaacaactggtaaaaaaatcaga
gatgggctgggcgcggtggctcacgcctgtaatcccagcactttgggaggctgaggtgg
gcggatcacgaggtcaagagatcaagaccattctggctaa >IGR1222a
ggaggttttttaagggggaggtcaaagagaaaggactgagtttggttttggaaacgttg
aacctaagttgtctttgaaacaactggtaaaaaaatcagagatggggctgggcgcggtg
gctcacgcctgtaatcccagcactttgggaggctgaggtgggcggatcacgaggtcaaga
gatcaagaccattctggctaacatggtgaaaccccatctctactaaaagtacaaaaatta
gccaggcatggtggtgcacgcctgtagtcccagctactcaggaggctgaggcaggagaat
cgcttaaacccgggaggcggaggttgcagtgagctgagatttcaccactgcactccagcc
tgggtgacagacagagcaagactccatctcaaaaaaaaaaaaaaaaaaaaaaatcag
aaatgggtaaataggtctgggtaaatgggtctggaaacagaggtctggtttggagatatg
acataaatctgtgagtcatctatgaacacagagtagtttgagcaatggataagaatgtga
ttacctaggaagaaaatacagagcaaaaaaaggagaagatacaggactgagcctaatga
gacttccaacctttattgatgggtgaatgaagtagtatgtagctgtgatagaaagagag
aacagtattgtatcatggaggtctagaaaagaaattttc >IGR1223a
ctatgaacacagagtagtttgagcaatggataagaatgtgattacctaggaagaaaatac
agagcaaaaaaaggagaagatacaggactgagcctaatgagacttccaacctttattga
tggggtgaatgaagtagtatgtagctgtgatagaaagagagaacagtattgtatcatgga
ggtctagaaaagaaattttcaaataaaaagtaataaactagcattttacttagctatggt
acatggaacaatggtcctccaagatgtccacattttaatcccttgaatttgtgaatgtta
cattgcacagcaaaagagaattaagattacagatggaattagggtgttaatcatttgacc
ttaaaatagactatcctggattatttggatggggcaaatgtaatcacatgggtcctttaa
tgtgagagaggaaggcagaagaagagagaagaaggaggtcacagtgatttgatatgaag
aactctgcccactattgcttgctttgaagacagagtaagagggcatgatctaaaaaatat
gggtggcctctaaaagacggaaagaacaaggaaacatattctcccttagagcctccagaa
aggaacgtaaccctactaacatcttgattttagcccagtgagacccaattcagacttcta
aactacataagtgtaagataataaatttgtattgtttata >IGR1224a
tgctttgaagacagagtaagagggcatgatctaaaaaatatgggtggcctctaaaagacg
gaaagaacaaggaaacatattctcccttagagcctccagaaaggaacgtaaccctactaa
catcttgattttagcccagtgagacccaattcagacttctaaaactacataagtgtaagat
aataaatttgtattgtttatagcactaagtttgtggtttcttatagcagtcatagaagac
taatacatgaactcttactacatgttaagcattttatatgcattagctcaaccttgacaa
catctaagatacacacagtgaaaatgaatgcctacttacaaatgaaataaacagaggct
cactcttaggtctactttgtatagcagcagcattaccctaattaaaaacagagttattag
taactttagtcagaggtgtttcaaaggacgaatgggactgcaattggagtgaagaggagg
tgaagaaatggagacagtatcaacaactcttttgagagactggctataaaggagaagaag
gagacaggtagtaactggagtggaatgaaatcccagggtatgagagatacttgagtgtgt
taaaatggcaatgatgaaaacctgcttgagaagccagtatagtgcctccagcacatagta
gatgtgcattattggttaaataaaggaattacttagctag >IGR1225a
tcaacaactcttttgagagactggctataaaggagaagaaggagacaggtagtaactgga
gtggaatgaaatcccagggtatgagagatacttgagtgtgttaaaatggcaatgatgaaa
acctgcttgagaagccagtatagtgcctccagcacatagtagatgtgcattattggttaa
ataaaggaattacttagctagttaaataaagggaggagaagaagctgaatagtcaagta
atttgctcaacaaagacagagacttgaatctaaggtagtctaatccccaaatccatatcc
attagaaaatgatacctgcctctaacagaatgataatggttgaaaggaacaatttatcat
tctttcctacttgtctgcttctcatctcacccattcttaaacatgacactagaatttttt
actcattcaacctgtatttgagtgattatgtgctttcaattcagcaactgttcagaaatt
actcaagagaatggaacataaccctaagtcttcatgggatcattctatttaactgacaa
atagtatccacaaaaaatcaaatgttcatagtggaggaggctgtgtgtgcgtggggtag
ggagaaaatggaagctcagtactttctgcccaattttgctataaacccaaaactgctcta
aaaaaataaagtctaaagtctattgaaaaaaatttaatat >IGR1226a
aaccctaagtctttcatgggatcattctatttaactgacaaatagtatccacaaaaaatc
aaatgttcatagtggaggaggctgtgtgtgcgtggggtagggagaaaatggaagctcag
tactttctgcccaattttgctataaacccaaaactgctctaaaaaaataaagtctaaagt
ctattgaaaaaaatttaatatgctcccctaaacttatagtagaaaacaaccatcaactta TABLE 5-continued cagacctaaaagactgaaaatgaacagaaattcaaatatcatataaacacctactttgtt
ctagtaatgactccttccagagttttaaattctgtcttttttgcttttctgagtacacacc
atagatctttgcacagctataagttctccattgacatcacgaaattgcagacgaatctgg
gctctcacatctgtttcttgagcaacctttgaaggaaaacacagaaaaaacttatgttac
tttaataagcaccagtgttggttctgagaaaaaggcataagcaatcttacccaaaatgag
ggaacaaaaagaaaaacatccaaaatgagtgatattttttacatgctatccaaaatataga
agaatactgtttaattaatttacaaaaatgatatactatctacctcctttattcagcatc
attaggagatcaggtatgcagattttttcaaataaatgaat >IGR1227a
ggttctgagaaaaaggcataagcaatcttacccaaaatgagggaacaaaaagaaaaacat
ccaaaatgagtgatattttttacatgctatccaaaatatagaagaatactgtttaattaat
ttacaaaaatgatatactatctacctcctttattcagcatcattaggagatcaggtatgc
agattttcaaataaatgaattttatctctgtaagcatcaaaaatgttttttatccttaa
aaaattgcaagttatagaaaggtagaatgatttggtttgtctttgtctccacccaaatct
catcttgaatttccacatgttgcaggaggtacccagttgaaggtaattgaatcatgggga
caggtctttcccatgctgttcttgtgacagtgagtaagtctcacgagacctgatggtttt
ataagaaggagtttccccgcacaagctctctttgcctgttgctgtccatgtaagatgtga
cttgcgcctccttaccttccaccatgattgtgaggcCtcccaagccaggtggaactgtag
tccattaaacccttttctttttgtaaattgtccagtctcaggtatatctttattagcagtgt
gaaaacggactcatacagtaaattggtaccaggagtggagtgctgctgaaaagttatccg
aaaatgtgaaagcgactttggaactgggtaacaggcagag >IGR1228a
caccatgattgtgaggcctcccaagccaggtggaactgtagtccattaaacccttttcttt
tgtaaattgtccagtctcaggtatatctttattagcagtgtgaaaacggactcatacagt
aaaattggtaccaggagtggagtgctgctgaaaagttatccgaaaatgtgaaagcgacttt
ggaactgggtaacaggcagaggatggaacagtttagaaggctcagaagagaggaaaatat
gggaaagtttgaactccctagagattttgttgaatggcattgaccaaaatgctgatgagg
atatggacaatgaaatccaggttgaggtggtctcagatggagataaggaacttgttggga
actggggcaaaggtgacttttgttatatttttagcaaagaaactggcagcattttgcccct
gcccctaggaatgtgtggaccctttgaacttgagagagatgatttagggtatctggtgaaag
aaatttctaagcagtaaagcattcaaggggtgacttgggtgctgttaaagggatgcagta
ttaaaagggaaacagcataaaagtttggaaaatttgcagcttgacaatgtgatagaaaat
aaaatcccatttttctgaggaggaattcaagccagctgcagaaatttgcataagtaacaag
gaaccaaatgttaattaccaagacaataaggaaaatgtct >IGR1229a
cattcaagcggtgacttgggtgctgttaaagggatgcagtattaaaagggaaacagcata
aaagtttggaaaatttgcagcttgacaatgtgatagaaaataaaatcccatttttctgagg
aggaattcaagccagctgcagaaatttgcataagtaacaaggaaccaaatgttaattacc
aagacaataaggaaaatgtctccaggggcatgtcagagaccctttgtgacagcccctccca
tcacaagcccagaggtttaggaagaaaaaatagtttcgtgggccaggcccagggtccctc
tgctgtgtgcggtctagggacttggtgccctgtgtcccagccacaactaaaagaagccaa
ggtacagcttggcctgttgcttcaaagggtggaagcccgaagccttggcagcttccacgt
ggtgttgagcctgcaggtgcacagaagtcaagaaatgaggtttgggaacctctgcctaga
tttcagagggtgtatgaaacacctggatgcccaggcagatgtttgctgcagggtggggg
cccttatggaaaacctctgctagggcaatatggaagggaaatgtggggttgaaaccccac
agagttcctatggagggactgcctagtggagctgtgagaagacagccactgtcctccag
actggtagatcccccagaataatagatccactgacagctt >IGR1230a
acacctggatgcccaggcagatgtttgctgcagggtgggcccttatggaaaacctctg
ctagggcaatatggaagggaaatgtggggttgaaaccccacagagttcctatggagggga
ctgcctagtggagctgtgagaagacagccactgtcctccagactggtagatcccccagaa
taatagatccactgacagcttgcactgtgcacctggaaaaactgcaggcactcaacacca
gcctgtgaaaacagccaggaaggaggctataccctgcaaagccagaagtggagctgccca
aggccatggaagcccacctcttgcatcagagtgacctggatgtgagacatggagtcaaag
gagatcattctggagctttaagatacacctgccccactgaatttcggacttgcacgggc
ctgtagcccctttgttttggccaatttctcccatttggaatggctgtatttgcccaatgc
ctgtatcccattgtatctaagaagtaactaacttgcttttgagtttacaggcgcatagg
cagaagggacttgccttatcttgggtaagactctggactgtggacttctgaattaatgct
aaaataagactttgggggactgttgggaaggcatgattggttttgaaatgtgaggacatg
agatttgggaggggccaggggtggaatcatatggtttggc >IGR1231a
aagaagtaactaacttgcttttgagtttacaggcgcataggcagaagggacttgccttat
cttgggtaagactctggactgtggacttctgaattaatgctaaaataagactttgggggga
ctgttgggaaggcatgattggttttgaaatgtgaggacatgagatttgggaggggccagg
ggtggaatcatatggtttggctgtgtctccactcaaatctcatcttgaatcccatgtgt
tgtgggagaaaccaggtgggagataattgaatcacgggggcaggtctttcctgtgctgtt
ctcatgatagtaagtctcacgagatctgatggtcattataaggggaattttcctgcaca
agctctcatttgccaccatgtgagacatgactttcaccttccaccatgattgtgaggcct
ccccagccacgtggaactgtaagtccattaaacctctttcttttgtaaattgcccagtct
tgggtatgtctttaacagcagtgtgaaaatggagtaatacacagaactacagtatacata
gctttcctgccccccaaaccacatgagagtaagttgctgatctgatgtcccaacaccagt
atttcctacaaaacaaggacattttcaacaacaaaaatcaggaaactgatactgatatat
tattaccacatggtccacaaatcccattcaagtttttgcca TABLE 5-continued >IGR1232a
agtgtgaaaatggagtaatacacagaactacagtatacatagctttcctgcccccccaaac
cacatgagagtaagttgctgatctgatgtcccaacaccagtatttcctacaaaacaagga
cattttcaacaacaaaaatcaggaaactgatactgatatattattaccacatggtccaca
aatcccattcaagttttgccagttgttccaaaatgtgataagttaccattaactcagctg
tggcatataaaataatggttctccaaagatgtccacattctaatcccttgaatttgtgaa
tgttacattacacagcaaaagagaattaacattacagatggaactggggtgtcaatcact
tgactttaaaatagaaagattaccctggattatttgaatgaggcaaagtatctacaaaaa
gttagatgctgatagtagaggaggttgtgtgtgtacaggcagggaatatacagaaactgt
actttctgctcaattttgctataaacccgaagctgatctacaaaataaagtttaaagtct
gttgaaaaaaatttaatatgctcccttaaagtagtagaaaatgaccatcatcttataaga
cctaaaagaccaacaatgaacagacattcaaatatcatataatcacctattttttctgat
gtcttctgtcttatattaatatggtcacttcagcattctt >IGR1233a
tataaacccgaagctgatctacaaaataaagtttaaagtctgttgaaaaaaatttaatat
gctcccttaaagtagtagaaaatgaccatcatcttataagacctaaaagaccaacaatga
acagacattcaaatatcatataatcacctattttttctgatgtcttctgtcttatattaa
tatggtcacttcagcattcttttcattagctggcacggtatatttttccatccttttgt
tttaaacccatctgtactattatatataaaaacactgttattcctttactttattttagg
gtttttttggttattgtcctccattttttctcatgttttttattttttatgtttttatttatat
ctatgaacatagttataagattataataagattttaaggttcttatctactaattctat
catctattcatccctagggtacttctgtggatgccttcctcactcagtcctacctaatgg
cttttggactgaattaatcaggaatgaataactattcatccattagttatgctgagagtt
tttatcatgaatgagtattaaattgaaaagcttttttctgtatctattgatgctcatatga
ttttttcttcttttattctattactgtggcaaattatactgattgttttttttcttttttctac
agcctaattcacttgtcccagtacgtcctttagagcaaaa >IGR1234a
aggaatgaataactattcatccattagttatgctgagagttttttatcatgaatgagtatt
aaattgaaaagcttttttctgtatctattgatgctcatatgattttttcttcttttattctat
tactgtggcaaattatactgattgttttttttcttttttctacagcctaattcacttgtccc
agtacgtcctttagagcaaaaggattcagttcagaattacactttgtatttgtggttat
gtctctttacttttcttcagcctgaaatagttgctcagattttccttgacttttcatgact
gataattttgaaaagtacagaccattattttgcagaatacctcccaaaatttgggtaata
tttcctcacgactagaatcaggttatgtatctttggcaagaatattatacaagcgatgat
gagttccttttactgcatctcatcagacaggacatcatttccatttatctcattacggag
ggtattaacttcaatcccttatttattttttttgagacagggtctcactttgtcatccag
gctggagtgcagtggcatgaacacagctcactgcatccacgacctctgagtcataagcaa
tcctcctacctcagcccccaagtagctgggactataggtgcatgccaccacacccccgcc
aatttttgtagttttttgtagagatgtggtttcaccatgtt >IGR1235a
ttatttatttttttgagacagggtctcactttgtcatccaggctggagtgcagtggcatg
aacacagctcactgcatccacgacctctgagtcataagcaatcctcctacctcagcccccc
caagtagctgggactataggtgcatgccaccacacccccgccaatttttgtagttttttgta
gagatgtggtttcaccatgttgcctagactaacttcaatctcttgataaaggtgtatctc
ctagcttcaccaaaaaattttttctttacaattaattaataatttgagggagagatgcaga
gaccatacaactatctcatacttcatcaaactttcttccattagttttagcatctactgt
ttcttacctgaatgaattattattatgacagctatcaaatacaggcatacccccatcttat
tgtgctcttcagaggtttgtggcaaccctgcatctaacaagtctatcggtgccatttttc
caacagcatgtgctcactttgtgtctctgtgtcacattttggtaattctcacaatatttc
aaactttttcattattattgtatctgttatagtgatctgtgataagtgatctttgatgtt
actactgtaattgtttgtgtgccacaaaccatccacatataagaggtgaacttaatccat
taacgtgtgtgtcctgactgctttactgacctgccattcc >IGR1236a
tgtgtctctgtgtcacattttggtaattctcacaatatttcaaactttttcattattatt
gtatctgttatagtgatctgtgataagtgatctttgatgttactactgtaattgtttgtg
tgccacaaaccatccacatataagaggtgaacttaatccattaacgtgtgtgtcctgact
gctttactgacctgccattcccgtctctctccctctccttggaacctgattgcctgagac
acaataatatggaaattaggccaattagtaaccctacaacagcccctaagtgtttaagcg
aaagaagagtcaaacatctcgttttaaatcaaaaactagaaatgattaagcttagttgag
aaaagcatgtcaaaatccaaaacaggttgaaagttaggcctcttttcatcagttagctgag
ttgtgagggcaaaggaaaagttcttgaataaaattaaaagtgctactttagtgaacacac
aaatgataagaaagtgaaacagccttactgctgatatggagaaagttttagtagttggga
tagattaaaccagccacaacattccctcaggccaaaacctaatccagagcaaagcccccaa
ctctctgcaattctatgaaggctgagagaagtaaagaagctgcaaagaaaagttggaagc
tagcaatggttggttcatgaggcttaaagaaagaagctgt >IGR1237a
cagcccttactgctgatatgagaaagttttagtagttgggatagattaaaccagccacaa
cattccctcaggccaaaacctaatccagagcaaagcccccaactctctgcaattctatgaa
ggctgagagaagtaaagaagctgcaaagaaaagttggaagctagcaatggttggttcatg
aggcttaaagaaagaagctgtctccacaacataaaagtgcgaggtgaagcagcaagtgct
gatgcaggagctgcagcaagttatccagaagatctagctcaggtaattgatgaaggtagc
tacactaaacaacagattttcaatgtagacaagaccgccatccattagaacttaacctgc
aatatctcaaggtatgcctatagtaattttctagttccattattccttttatattagttaa
ggttctagtataaggggctttgctcttttctccatttccccccccatttttcttgtatcagt TABLE 5-continued ataaactcatagattccttacttgggctccaatcccccaccaggctgtcacagcttgttt
ttgtggatgccttcctcactcagccacacctaacggattttggactgaattattcaggaa
ttaatattcctccatcagttatgctgagggttttaccacgaaagactattaaattgaaa
tgcgttttctgtatctattggtgttcatatgatatttctt >IGR1238a
acttgggctccaatcccccaccaggctgtcacagcttgttttttgtggatgccttcctcac
tcagccacacctaacggattttggactgaattattcaggaattaatattcctccatcagt
tatgctgagggttttaccacgaaagactattaaattgaaatgcgttttctgtatctatt
ggtgttcatatgatatttcttttttattctgttaatgtggcaaattatactgattggttt
cttttctaccgtatctctctaagcattatctagctgcaccccacatattttttacatgcta
tattttttgattcatttaaagtattttttctaatttcccttgtgattccttttttgatcca
tgtaatatttagaagtatgctgcttaattttttcaattattttgggatttttccggatactt
ttctgctactgattctggtgtagtcacagaatacattatctatgactttactccttataa
atttattgacacttgttttacagtccagaatgttggtctatcttacagaatgttccacat
gcacttgaaaataaagtgtattctgctatcgttcaatggaatgtcctataaatgtcaatc
aggttgatttggttaacagtgttgttaaaattttccatatacttactgatatttcatctg
cttcttttctctactgagagggtattgagatctccaatt >IGR1239a
acagtccagaatgttggtctatcttacagaatgttccacatgcacttgaaaataaagtgt
attctgctatcgttcaatggaatgtcctataaatgtcaatcaggttgatttggttaacag
tgttgttaaaattttccatatacttactgatatttcatctgcttcttttctctactgaga
gggtattgagatctccaattgaccttgcagatttgtgtatttctccattctgttccata
ggtttctgcctcatatatttggaagttttacatttagaattttttgtgtccttgcattaaa
ttgacctcttctcatcataaaatgtttcattttccctagttctgatgtcttctgtctggt
attaatatggtcacttcagctttcttttcattagctggcacagtatattttttcaatcct
tttgcttttaacctatttgtaccattatatacaaaacaccattattccgtttatttgggt
ttttaaaattatttttccattttttctcattatgcttatgtttttccttttatatctatgagca
tatttataagagttataataaggttttagggttcttatctactaattctattatttctttt
cattttggatctgttcatatgattgattttctctgattatgggtcctatttccctgctt
ctttggatgccttgttaacttttgattgtgaattttgtatt >IGR1240a
ttttctcattatgcttatgtttttccttatatctatgagcatatttataagagttataat
aaggttttagggttcttatctactaattctattatttctttcattttggatctgttcata
tgattgattttctctgattatgggtcctatttccctgcttctttggatgccttgttaact
tttgattgtgaattttgtattgttgggtgaaagattttgttttattccttaatgagtac
tgaactttgttctggcatgcagttaagttttttgagcaacaaacagttggattcttttga
acctttgttgttaaggtctgtaaaggggggacctagagcagcttttactctaggactaatt
tacaatcattttcgacattttccttcagcctcaaaaacttttcttttaacaattactatagt
gcaagcctgtctgtaacaaattacctctaccattttgttttaaatctgaaaatgtcctcc
atttcacctccaattttcaaagaatattttttgctggatataggagtttaacttttattcc
ctagcaccttaaaggtgctgtcccactgttttcaggtttagattgcttttcctaagaagt
aatcatactcattattctttccctctgcatgatgtgttacttttttcctccacctgttttt
aagatttttatatttagttttgaacaatttgaatgtaatgt >IGR1241a
aagaatattttttgctggatataggagtttaacttttattccctagcaccttaaaggtgct
gtcccactgttttcaggtttagattgcttttcctaagaagtaatcatactcattattctt
tccctctgcatgatgtgttacttttttcctccacctgttttaagatttttatatttagtttt
tgaacaatttgaatgtaatgtacaacatagttatgtttatgctgcttgtgatgcattcag
cttcttgggtctttttttatagttttttattactctgtttagatgtcttcccacacattat
gtccatctttttcctttaagtccttgagcttatctatcatagctttaaaaaaaatccggtcg
ggcgtcgtggctcatgcctgcaatcccagcactttgggaggccgaggcaggcggatcaca
aggtcatgagttcgagaccaggttggctaatatggtgaaaccccgtctctactaaaaata
aaaaataaaaaataaaaatcagccgggcatggtcgtgggcacctgtagttccagctac
tcgggaggctgaggcaggaaaattgcctgaacctgggaggcacaggttgcagtgagccga
gattgtgccactgcactccagcctgggaaacagagtgagactccatctcaaaaaaaaaaa
tttaaaaaaattaaaaaaaaatccttgtctgctaattc >IGR1242a
atcagccgggcatggtcgtgggcacctgtagttccagctactcgggaggctgaggcagga
aaattgcctgaacctgggaggcacaggttgcagtgagccgagattgtgccactgcactcc
agcctgggaaacagagtgagactccatctcaaaaaaaaaatttaaaaaaaatttaaaaa
aaaatccttgtctgctaattccaaaatctgtcatctctggatctgcttctactcacttttt
cccttctcaggtatagaccacattttcttttgcatattcccattaattttttaaaattata
ttctgcacattgtagatgccacattgagagcttcgactgagtaggcttcctttaaaaagt
cttgagttttgttctagcagccagttaatttactggcaactcagcttgattctatcaaaa
cctggtttcagtatttgttaggtgggccttttctgaggtctcaagtgaacactggagagtt
ccacaaggtcactccattctggcacatcaggactcaaatgtctcacagcattgtgtgacc
tttagaatacaacactcacagccccacttgccaccttggtagttgttctctactagccct
cattaaatctcatcctatacatggatagcttagtatttggccaaagactcaaaagatcct
tatgcagatttctggtacaccatctctgcacaacaaccct >IGR1243a
tggcacatcaggactcaaatgtctcacagcattgtgtgacctttagaatacaacactcac
agccccacttgccaccttggtagttgttctctactagccctcattaaatctcatcctata
catggatagcttagtatttggccaaagactcaaaagatccttatgcagatttctggtaca TABLE 5-continued ccatctctgcacaacaaccctacttcagtactctgctctacaatttccagtcactttagc
aaatccaaaatcctatctttgtttcatctgcctagtgatgcccaattctgcccagctctc
tactggattccaattccatgtgccaaagtttacaaagtgttcccaggtagaaagctggaa
tgaatgcagaatcacctttatgtttctcctttctcaaagaatatagccctgcattatct
gtggtccaatgcctgaaaatagttgtttcacatacttttccagtgttacagttattcatc
ttgcgagtataagtgtgatactcattattttgttgcaacccaaatcacaagtactggatt
ctgctttaaaaaaaaaaatcattaaagatccttttgctgacttttaatgacttcttggc
atgaatttaactttgatactaattcaattaatcattcaacaaatatttacaggcactttg
taggtttcatgtgttgttttggttcaaactgacagactttt >IGR1244a
actcattattttgttgcaacccaaatcacaagtactggattctgctttaaaaaaaaaaa
tcattaaagatccttttgctgacttttaatgacttcttggcatgaatttaactttgatac
taattcaattaatcattcaacaaatatttacaggcactttgtaggtttcatgtgttgttt
tggttcaaactgacagactttttttcctttgaagcatgcaagataggtttaaatgtagaca
aggtgtgctaaacaccatcataagcacaggataatctgggagtacaaagcaggagcatct
aacctatctaggacagctcagggaaggtagtctaaaggaagtgaatgtttaaatgaaact
tctaccaatctgggtagaagttaaccagatgagaagatctgagtcactacgtgactacag
aaatttcagaatgtttggcatagaaagtagggaaaagaagagtatcaacctaaaatgttt
cagaaattaacagccttctaaacttggtaaggcttttggatttaaggtgatggcactaaa
tggtttgaaccaggggaattgcatgaagtagatatgcattttagaagaattattttgtct
ttagggtgaacagagtgaactgagacaagacatgaagcagggaataatcgaggagagata
ggaaggcagcctggacaagggttgaggatggaggtaaaga >IGR1245a
aaacttggtaaggcttttggatttaaggtgatggcactaaatggtttgaaccaggggaat
tgcatgaagtagatatgcattttagaagaattattttgtctttagggtgaacagagtgaa
ctgagacaagacatgaagcagggaataatcgaggagagataggaaggcagcctggacaag
ggttgaggatggaggtaaagaggaagaagtcgctgaactggtactcagaaacagcctct
taggatacagacatttcaatgaggaggtggccagaggtcagtataaagctttgaaagccc
agacttgactctgtcatttcatcataaggagagcattctgctgaaggtttaatccacagt
agttgaactaaggagctatgtatttatgcagcaaaaaattaatttgtttacagtgttcct
gagtagcaagccaaatacacatactcttttctccatggcatctactttttcgaggacctagc
tacccggcaaacatcaaattagtaaatagaattcaagcaagggctatcttgtagcatttc
tatcactacattgttgttgacactcttattgaagaagagtcacttcaaaagtgaagtgta
atttagattgaattattaaaacaaagaaatgtgtattatacttcagaacaatttctatca
aaagaataaaataaaaaataagaaaaaccttctttctc >IGR1246a
tagtaaatagaattcaagcaagggctatcttgtagcatttctatcactacattgttgttg
acactcttattgaagaagagtcacttcaaaagtgaagtgtaatttagattgaattattaa
aacaaagaaatgtgtattatacttcagaacaatttctatcaaaagaataaaataaaaaa
taagaaaaaccttctttctccaaacaatctagttgtaaaaccattaggtggggcagaag
aaggtgcgtgttcatgccagctgaaggttaaggcacctataactcagcctagagtggaat
aaatgagcttgagtaggctgagaagggtaccctcatggggaaacagcttggcatagacag
agtttcaagagtccaatgtatcagagttccagcaggatgaaagagggaatccacaaatag
gggggatccagctcagaagcagagtgtccacgccagggaatagtgtgggattcagagcc
tgataatgatgagaaggggccccacctgagggttaagtcggctaggggaagtcagatca
tagagtagagacggcattcttgcaagaagccacctggtataaagtatcagactgagaaga
gtgaccctctcagtgacacagatctggggagattcaggtcagagtacagtgggcatccct
gcaagaggccacctggtatcagagaagggcggggaatgag >IGR1247a
gcccacctgagggttaagtcggctaggggaagtcagatcatagagtagagacggcattc
ttgcaagaagccacctggtataaagtatcagactgagaagagtgaccctctcagtgacac
agatctggggagattcaggtcagagtacagtgggcatccctgcaagaggccacctggtat
cagagaagggcggggaatgaggacatgatctagcaccagaagtcaaagtgtatacagaat
ggaaaagcatcccatgagggagtcagaatgaagagtcaagagcctacgcaggataaggaa
gactggcatacagggatggagtcagcccatatgaggtgctagggccctgatgcaacgatg
agacattgattacatacaggaggattgattaagtcaatatattaagattatggttgtata
agtacattcttgcactgctataaaaaaaaacctgaaactgggtaacttataatgaaagg
aggtttaattggctcacagttccacatgctatacaggaagcaagactgggagacctcag
gaaacttacaatcatggcagaaaggcaaaggggatgctggcacatcttacatggctggagc
agaagaaaagagtaaaggggaattgtgacagatttttaaacaaccagatctcatgaga
atttactcactatcatgagaacagcaaggggaaatctac >IGR1248a
ttccacatgctatacaggaagcaagactgggagacctcaggaaacttacaatcatggca
gaaggcaaaggggatgctggcacatcttacatggctggagcagaagaaaagagtaaagg
gggaattgtgacagatttttaaacaaccagatctcatgagaatttactcactatcatgag
aacagcaaggggaaatctaccccccatgatccaatcaccccaaccaggtccctcctgcaa
caagtcctgcagacttctgcctggacatccagacgtttccatacatcccctgaaatctag
gtggaggctcccaagcctcaactcttgttctctgcgcaaccccaggcttaacaccatgtg
gaagctgccaaggcttacagcttgcagcctctggagcagcagcttaagatatatctgggg
cccttttagccatggctgggagctgagtggctgaaacacagggagtagtgtcctgtaatg
ggaggggctgctgtgaagatctctgaaatgccttctagccatttccccagtgtcttggc
tattaaacattctgctcctctttacttatgcaaatttctgcagccggcttgaattcctcc
ccagaaaatgggttttcttttctaccacatgatcagggtgcaaattttccaaactttta
tgctctgcttccctttaaaataagttccagtttcagat TABLE 5-continued >IGR1249a
tctctgaaatgccttctagccattttccccagtgtcttggctattaaacattctgctcct
ctttacttatgcaaatttctgcagccggcttgaattcctccccagaaaatgggtttttct
tttctaccacatgatcaggtgcaaattttccaaacttttatgctctgcttcccttttaa
atataagttccagtttcagatctctttgcttgcacatatgagcatatactgctagaagca
gccaggccacatgttgaaagttttgctgcctggaaatttcttccaccaaatactctaaat
catctctttcaagttcaaagttccacagattcctagagcagggcacaatgctgccagtc
tctttgctaaagcatcgcaagagtgacctttactccagttctcagtaagctccttatctc
catctgagacctcctcagcctagacttcattattcatatcactgtcagcattttggtcaa
aataatttaacaagtctctaggaagttccaaacttttcctcatcttcctgtcttcttttg
agccctccaaactgttccaacctctacccattacccagttccaaagtcacttccacattt
tcagctatctttatagcaatacccactctcggtaccaactttctgcattagtctgttttt
ctcactgctacaaagaaatacctgaaactggttaaagaaa >IGR1250a
aggaagttccaaacttttcctcatcttcctgtcttcttttgagccctccaaactgttcca
acctctacccattacccagttccaaagtcacttccacattttcagctatctttatagcaa
taccctactctcggtaccaactttctgcattagtctgttttctcactgctacaaagaaat
acctgaaactggttaaagaaaagagggtttaattggctcacggttctgcaggctgtacagg
aagcatgactgcggaggcctcaggaaacttacaatcatggcagaaggtgaagaggaggct
ggcacatcttacacggccagaacaggaggaagagagtgaaggggaggtgctacacactt
taaacaatcagatctcatgagaacttactatcacaagaactgcaaggggaaatccacc
tccatgattcaatcacctcccaccaggcccctcctccaacaatgggggttacaatttgac
atgagatttgggcagatacaaattcaaaccatatcggtactcaattccttgcttctcatt
accttcatagtatttaccaaatccccaaccatggatatatgcaacttttccaatttattca
gtgcttgggctgaacaagactgaaaaaacataacaaccatgatggctggtctctcttta
aattttcacaaaaccctgacactgtcatgtaatcccaga >IGR1251a
aaattcaaaccatatcggtactcaattccttgcttctcattaccttcatagtatttacca
aatccccaaccatggatatatgcaacttttccaatttattcagtgcttgggctgaacaaga
ctgaaaaaacatacataaccatgatggctggtctctcttttaaatttccacaaaaccctg
acactgtcatgtaatcccagaacacctcccttaatcaatttacttactgaggttaaaaac
tattctatgttttctaggctcaatcaacccctttctgccactctcaaccagtaacttcatt
tcttttttcatttgagaatataaaagcaatcaaaagagaacttactcattcttttcaccac
taaagtttccaatcatataatctgcctaaatccctgttacaatggataacagtggatgtt
cctggtatcccctccagttgggcaatggatcttatctcttttttgcctactcaagaattgt
gctctgtaattatccctctcctgcatcaatgtttctgtccagagtcattcccaacagtc
tacaaatgctctagtatatcccacttttaaaaacacaataaaacaacaacaacaaaactt
tccttttatcctgttaacctcttcagctactgtcctatgtctgtgtccacttacaacaaaa
ttcataaaataattctgtttcacttctttatcttttctct >IGR1252a
tcctgcatcaatgtttctgtccagagtcattcccaacagtctacaaatgctctagtatat
cccacttttaaaaacacaataaaacaacaacaacaaaacttcctttatcctgttaacct
cttcagctactgtcctatgtctgtgtccacttacaacaaaattcataaaataattctgtt
tcacttctttatcttttctctgattactggaactggttttgtcaagagcaacaacggact
ccacatatccaaacactcctcttctttcttgagctatcaacatatttgacacagttgatg
atttcctccttataacacttttattctcttgtcttccaagacaccactctctcagttttcc
ttacttaacgaattgctctcttttactagcttctcctcctcttcccaatttctaaaggcatc
atcggctctagtgctctaggttaaggtcttgaatatcttttccatattcactctctattt
gatctcatcaggctttaaaaattaactatgtggaactacctgtatacactaatgattcct
aattttctttctccagtcctaatctctcttcctgaacagacttctgcttgccaactggaca
tctccttggatatttaacacatatccctaatttgcatgtttaaaccagatccacccaaa
tatttttttccatagtgccctattataaatgacaaaa >IGR1253a
aattaactatgtggaactacctgtatacactaatgattcctaattttctttctccagtcc
taatctctttcctgaacagacttctgcttgccaactggacatctcctttggatatttaac
acatatccctaatttgcatgtttaaaccagatccaccccaaatattttttccatagtgccc
ctattataaatgacaaaactattttatccagttgttcaagcaaaaactttggagtt
atgcttgatgcttttacttctttcatacaccattatccaaaccattagctaaatttgttgg
ttctatcttcaaaatacatcctaaatccaaacattttctcaccattctaccactaccttaa
tgaagccacctatatttctcacctggatcatcacaaaatcttcttaatttgtctctgccc
tatctttgctacctacggacagtcttctctcagcaaccagactgagcactttaaaagata
aatcagaccatgtcctttccctgctcaaaatctcccaatagacagattcctatttaaata
agactagaatccaaggacctacaggatctagtctctcctatcttttctaactttattttct
accatttttccttgttcttccttgtcattccttgaacacaccaaccatgctcagggactc
tgcaactagactgaatgaaatgttttcttcccagattttg >IGR1254a
cctgctcaaaatctcccaatagacagattcctatttaaataagactagaatccaaggacc
tacaggatctagtctctcctatcttttctaactttattttctaccatttttccttgttctt
ccttgtcattccttgaacacaccaaccatgctcagggactctgcaactagactgaatgaa
atgttttcttcccagattttgaacaactcattccctcttgaatgaatatttaaaagacaa
ctctgattactctgtgagaaagagagagcttcaagaatgagggcaggaaaataagttagg
agacgattctaatagttgaaagggaatatgatggtggcttggaacaggaacacagtggcc
gatggaatgaagtagacaaattctgacatatttttagaagggtaggtaagaattgcttatg TABLE 5-continued tagggatgatgacatcatttacaaaactggcgggggtggggtactgaggtagtaacagag
ctgagaatgtaggcaggaagtgggtacaaggaatcaagagttctgttttgaacatgttaa
atttgagatgcccattaaatatccaaacaaacagctagacatatatgtctagagttaagg
aaagaagtcagggtcaaatatataaatgtggtagttaccagcacataaccagtacttaaa
gccgttagactgaataagctcatccaagagagatagggaa >IGR1255a
gtgggtacaaggaatcaagagttctgttttgaacatgttaaatttgagatgcccattaaa
tatccaaacaaacagctagacatatatgtctagagttaaggaaagaagtcagggtcaaat
atataaatgtggtagttaccagcacataaccagtacttaaagccgttagactgaataagc
tcatccaagagagatagggaagagggttaatgcaaagatggccaactcttgtgtcacact
ggcttttagaaatcaaggcaggttgggtgcagtggctcacatctgtaatcccagcactttg
ggagactgaggcaggtggatcacctgaggtgaggaggttgagaccagcctggccaacatg
atgaaacccgtctctgctaaaaatacaaaaattagctgggtgtggtggcacaccgtaa
tcccagctactcaagaggctaaggcacaagaatagcttgaacctgagagacagaggttgc
agtaagccaagatcatgccacactgcactccagcctgggcaacagtgcaagactccgtct
cataaaaaaaagaaatcaagcaaaggtagacccaacaaagactaaagtatagccagtga
gaaagaaggaaactatgagattatagtgtcacaaaagccaagaaggaaatatattttaaa
aaagaaatagccaactgtgtcaaatctgacaagatgttaa >IGR1256a
acactgcactccagcctgggcaacagtgcaagactccgtctcataaaaaaaagaaatca
agcaaaggtagacccaacaaagactaaagtatagccagtgagaaagaaggaaactatgag
attatagtgtcacaaaagccaagaaggaaatatattttaaaaagaaatagccaactgtg
tcaaatctgacaagatgttaatgagaattagaaactgaccactctatctggcacattgag
attattggtgacctacaaaggcacttttagtggaggaaaaaagaaaacctgaatggag
tagattgagggaaaaatgggagtcaatgaagtaaagacaatgaggacatacaaatcttat
gaattttgaaatatattggaacagagaaaggtaatggctagagggtaaattggagtaaa
gggagagttttttgtttgaagactagagataccagagcatgtttatatgctgatgtgaat
gatccatcaagagaaactgctgatccaggagagagatggaaaaactgaagggcaaaatcc
ttgggtggataagagggatcaatgagatctagcctccaaggagctggttcatgtttagat
aaaacaacaaataatttatccaagaaaaaacagtatgggcacgtatgtacagtagtttcg
tagatgtgatgattggaaaataagggaattctcatttgat >IGR1257a
ctgatccaggagagagatggaaaaactgaagggcaaaatccttgggtggataagagggat
caatgagatctagcctccaaggagctggttcatgtttagataaaacaacaaataatttat
ccaagaaaaaacagtatgggcacgtatgtacagtagtttcgtagatgtgatgattggaaa
ataagggaattctcatttgattcttcctatttctcaataaagtacaaagcaagatcatca
attaaggaaagtagattgtagatttaaggagagagaaggtgggaaacagtcattatggag
aggactcagtaaatgtactaaaatactattacatttctaagaggaaaattcataaatattt
tcataattacagagttatctttaatcacactaaggtagaaacaaataataatcaacaggg
ggtcatttaataaaactacaggatataaactcaatggaatacaatttactaattaaaaaca
ataaaatagaagtataaaattatattaatgtgctaaaatatgtatgtgtgaatgcattta
tgtgctcacgtagacatggttttataagcagaaaaaagcttggaagaatacgtaacgaaa
acatagtggaactggggtcagggagcggctagagaggcacatgaccccactaaaaacgaa
taaactatatatatgtgtgtgtgtgtgtgtgtgtgt >IGR1258a
ttatattaatgtgctaaaatatgtatgtgtgaatgcatttatgtgctcacgtagacatgg
ttttataagcagaaaaaagcttggaagaatacgtaacgaaaacatagtggaactggggtc
agggagcggctagagaggcacatgaccccactaaaaacgaataaactatatatatgtg
tgtgtgtgtgtgtgtgtgtattgttgtttcacttctatatgtgcaaaaacaaacct
atagaccaaattctatgtcctttcacacatacgaatagtataaacaccataattcaaacaa
tgattcatacacaaagattttttatcatgatactttttttctagacagtgggtctcacta
tattgtccaggctagccttgaactcctgggctgaagcaatcctcccatctcagcctctag
agctatctgggagtattggcacacaccccaagcctggcttatcatggtacattttaatg
aaaaactgaaagcaatctaatgtaagaaaattacataactactaaagtgttcatgcactt
taagtagaaaatatctcagacatacaaagcagtataaagattaaaagaaacacttacata
ccaaacacccagatgatagttttttaatgacataggacttcatgataatgttaagtgggg
aaaaaaacccagaatacaaaattaagagtatgacatcagc >IGR1259a
atgtaagaaaattacataactactaaagtgttcatgcactttaagtagaaaatatctcag
acatacaaagcagtataaagattaaaagaaacacttacataccaaacacccagatgatag
ttttttaatgacataggacttcatgataatgttaagtggggaaaaaaacccagaatacaa
aattaagagtatgacatcagctatataaaacagtatttaaaggaggaggaaaacacatga
aaatgtcaacaacggttactactgggtgctaaaactgtgtggggctgactttcatttctc
tttatagttttccagtgccaagttttctataataagctattatcatttttataattataa
aaatacaaaattgtactagcaccattaccttgggatcgtgtacaaatgtatttcctttgg
ttccaggagggaaatctccagtacaaatatattttagacattcaatggtggtctaaagaa
atagaaaattacattatttcgttataagagaaccacagaagtttaccataaaatatgaat
tcattacaaaaatattatttatcatggaaactataaaagataaaatctgacattataaaa
cctgtaataaaaaatgattaagtgttaatgctgtaagttcacagaaatgctatataact
aagaagttatcctaatatgaagaattgttacttgggaaaa >IGR1260a
cgttataagagaaccacagaagtttaccataaaatatgaattcattacaaaaatattatt
tatcatggaaactataaaagataaaatctgacattataaaacctgtaataaaaatatgat TABLE 5-continued taagtgttaatgctgtaagttcacagaaatgctatataactaagaagttatcctaatatg
aagaattgttacttgggaaaaaataattattttcaactgaaacccttaaactaattta
agttaataataagaatggctaacagttaagtactgtattgtactaagcactcttacatac
atttatttaattctcacattaactccaggctgtaggaactttttgtttaagagacagggt
ctcattctgctgcccaggctgcagtcagctgcatgatcatggcttactgcagcctcgac
ctctcgacctcctgggctcaagcaatccccagcctcagcctcccaaacggctcggatta
cagtcgtcagccaccatgcccagcctgtagaaactttttttttttttttttttttttgt
gggggagagagtctccctctgtcacccaggctggtgtagtgcaatggcgtgatctcggc
tcactgcaacctccacctcccggttcaagcgattctcccgcctcggcctccccagtagc
taggattacaggcatgcgccaccacgcctggctaattttt >IGR1261a
ccagcctgtagaaacttttttttttttttttttttttgtgggggggagagagtctccct
ctgtcacccaggctggtgtagtgcaatggcgtgatctcggctcactgcaacctccacctc
cccggttcaagcgattctcccgcctcggcctccccagtagctaggattacaggcatgcgc
caccacgcctggctaattttgtattttattagagatgggtttcgccacgttggccag
gctggtctcgaactcctgacctcaggtgatccacccgcctcggcctcccaaagtgctggg
attacaggcgtgagccaccgtgcccagctgtagaaactatttttaatctccatttttataa
atgagaaaactaaggcacagagcagtgaggtcactcgcaaacaatcagacaactaataaa
tgaagcgaaaaagctgtattgaggcagccagtcctcataaacactatacagtactatct
cccttctgctagtatttagtacaatcctaagtacataacaagcattcaacaaataacatt
tttacaaaaacaaaagtaaacaagtttggcattcaattctcaaccttctctctttctaca
ctcttcacaaatccttcctttagactcttctccctgctatactgacatcgtcttgctttt
tcttaagccactattcctgaccagaatgcctcttggttat >IGR1262a
tacaatcctaagtacataacaagcattcaacaaataacattttacaaaaacaaaagtaa
acaagtttggcattcaattctcaaccttctctctttctacactcttcacaaatccttcct
ttagactcttctccctgctatactgacatcgtcttgcttttcttaagccactattcctg
accagaatgcctcttggttattctttccattcaaatttataaatattcccacgcttaa
aaaaaaaaaaagtcagtcgtgcaccaacgttaaattttgactgagttttaagaagaga
agttttccaagttaagccccactacatcagttacattttgaatttatttattttccatgt
attatgtctggacagttggcatacttggaaactctttagtcatgtatgtatcattttata
actttaaaggaattcttgtatgggacaactactgggaagtgaatgctatgctttgaaag
caaggagacagcgttaaaaacatcaatacagaccaaagggcatccagtgggaactgaact
ctgagtgagcggcgacagctcccggtatcgtgggattcttaagtaaaccttgtccccagg
ccaggtccggacatccttccgggactgcttcaggcaaactcctaaggtcgctgtagcctg
caggccacaccctaaggcactttaagggcctacacctgtg >IGR1263a
acatcaatacagaccaaagggcatccagtgggaactgaactctgagtgagcggcgacagc
tcccggtatcgtgggattcttaagtaaaccttgtccccaggccaggtccggacatccttc
cgggactgcttcaggcaaactcctaaggtcgctgtagcctgcaggccacaccctaaggca
ctttaagggcctacacctgtggagccctagggacgcttctgctcctaaggagagttctca
acttcccatttattctccgaaagatgtagcgacctgtaaactgaaggcggctactgaag
acttaccgtctttcccgccccattgggtcaaccaaaattgtaagggggctgaagaaagt
gataatttgcttatctttgtcctctattccaaaactccgcacgcccagaatgctcatctt
ttcgatccgggacatgtttgcaaacgtttctaatctcaccagggacctggagtccacaaa
ggcttaactgaggccgaagcaaggcgtgcacgggacgtgagacccgcgaatctcagggtc
aggaggatccgggcggggagcgaggccacaggactgccaaaagatcctgccagccaacag
cggggagagaggggcgggggatggagcctttcctcccacaccagctgctttccccgccgg
tggggagagcggaggcggggaccagcctggggctgcccgc >IGR1264a
caaggcgtgcacgggacgtgagacccgcgaatctcagggtcaggaggatccgggcgggga
gcgaggccacaggactgccaaaagatcctgccagccaacagcggggagagaggggcgggg
gatggagcctttcctcccacaccagctgctttccccgccggtggggagagcggaggcggg
gaccagcctggggctgcccgccggggacgcaaagccgtagccacaatgcgacccgcaac
cgcgcactcacangcttcctgcctcggccgccctgcggatcacgtgggcctctaggcccg
cacgcgtccacgccgctctcctggggcacgccgggaaatcagagtcccgcggtgcgtgcg
cagctccgacttccgggtgcggtacggcgaagcagagggctaggtgctgggtgctgttgc
caggggcagcggacttccggatctttgctggggatgggcagcctggagaggcactgactt
ttggaagggagaccaagacctgtgacggatggcgcttcccaaagcttgatcctgggact
cctggaatgggggtagtggtggggtggattggagacccaggaagcggggtcagttcatgt
caaaactattttccttttcattctcattctctctaacgttcgtgtagtaatttccagt
gatcacataacatgtgatgacgccattgcagtggcggtta >IGR1265a
cctgtgacggatggcgcttcccaaagcttgatcctgggactcctggaatgggggtagtgg
tggggtggattggagacccaggaagcggggtcagttcatgtcaaaactattttccttttc
attctcattctctctaacgttcgtgtagtaatttccagtgatcacataacatgtgatg
acgccattgcagtggcggttaatggaatgtgcgcatgtgtattcttgcgcttagaaatac
caatttaattctaattgagtaaatgttgataattataactcacgtacacgctctttga
ggtcccccgtaatttttagtgtaaaggcgtctttaagaccaaaagtctgggaactaaaa
ctaaaagcagtctgcaaatatgaagaatgtagaggtaatccattccgatcagtgctccca
gcaatagatatctttaaaaataaggggaaagagaagttacctgtctcagaagtaactgaga
atattgctttcttggaaacaaacttaatggagggatatcacatttaagggcctagagaaa TABLE 5-continued catacataaaaattactgaaacaatagtggaggacatttaaatgaaacacaaatttggaa
ttactgtagtggtataatttgcctctgcctgccttggaaaaatgtaggaaatgtttctcc
agtcatacaatcccaagcaaataatttacagaacctaata >IGR1266a
aaacttaatggagggatatcacatttaagggcctagagaaacatacataaaaattactga
aacaatagtggaggacatttaaatgaaacacaaatttggaattactgtagtggtataatt
tgcctctgcctgccttggaaaaatgtaggaaatgtttctccagtcatacaatcccaagca
aataatttacagaacctaatacataaatgtatgtgccaaaggatgcaagtggggaagacc
agtgagaaatagtctcttgctgtaccaggttaaaaaaaccggaaagtgtcagttattaca
aaatagttaaaataactaatggaacaaaacattaaaattatataggaatgtcttacttgg
caaagcaaatgtaataaaacaatgggaaaagacgaaagacctttttttttattttaaaaatt
gtaaaatacacataaaatttactgtcttggccaggcgcggtggctcacgcctgtaatccc
agcactttgggaggccgagacgggtggatcacgaggtcaggaaatcaagaccatcctggc
taacacggtgaaaccccgtctctactgaaaacacaaaaaattagccgggcatggtggcag
gcgccgatggtcccagctactcaggaggctgaggcaggagtatggcatgaacccgggagg
cggagcttgcagtgagccgagaccgcaccactgcactcca >IGR1267a
acgggtggatcacgaggtcaggaaatcaagaccatcctggctaacacggtgaaaccccgt
ctctactgaaaacacaaaaaattagccgggcatggtggcaggcgccgatggtcccagcta
ctcaggaggctgaggcaggagtatggcatgaacccgggaggcggagcttgcagtgagccg
agaccgcaccactgcactccagcctgggcaacagagcgagactccgtctcaaaaagaatt
tactatcttaaccaagtgtacatttcagtggtgttaagtatactcacgtacaaccgtcac
cacctttcaacctctacaaatcttttcactttgcaaaacaaactacccattaaacaataa
cccttttcctccccacatcctccaaaccctgacaaccaacattctacttactgtctctata
attttttactaagtacctcatataagtggaatcatacagtatttatcttttttgtgactgg
ctcatttcacttataatgtcctcaaggttcatccatgttgcagctcagtccccaacccct
gggtcactgaccagtatgcatacctggcctgttaggaacctggtggcacagtaggaggtg
agcagcaggtgagtgaacattaccacccgagctgggcctcagatcagtgggggcattaga
ttctcataggagcacaaaccgtattttgaactgcccatga >IGR1268a
cctcaaggttcatccatgttgcagctcagtccccaacccctgggtcactgaccagtatgc
atacctggcctgttaggaacctggtggcacagtaggaggtgagcagcaggtgagtgaaca
ttaccacccgagctgggcctcagatcagtgggggcattagattctcataggagcacaaac
cgtattttgaactgcccatgagaaagatgtaggttgcccccatgcaagggatctagcttgc
ccattcctatgagaatctaatgcctgatgatgtgaggtcgaacagtttcatcccaaaac
catcaccccactcctgtctgtggaaaaactgtcttccgtgagactggtccctggtgccaa
aaaggttggggaccactgtagcatatatcagaattcaggtcgttttttaaggttgaataag
attcattacaatacacatcacattttgcttatccatctattgatggacatttgggttact
ttcacattttagctattgtgaatagtgtggctatatatattggtgtacaaatgtcacttc
tggaccctgctttcaattcttttgggtatatacccagaagtggaattattagatcataca
gtaattcaattttttaattatttgaggaactgccatactgttttccacagtggttgtacca
tttgacattccaccaatagtgcataagggtttcaatttc >IGR1269a
gaatagtgtggctatatatattggtgtacaaatgtcacttctggaccctgctttcaattc
ttttgggtatatacccagaagtggaattattagatcatacagtaattcaattttttaatta
tttgaggaactgccatactgttttccacagtggttgtaccatttgacattcccaccaata
gtgcataagggtttcaatttctacatatgcttgccaacacttgttatttttatgtttttt
atggtagccatcctgatgagtgtgaagtgatacctcattgtaattttgatttgcatttca
ataattattagtagcatcatttcatgtgtttattggccatttgtgtatctttgaataatt
gactattcaagtggagactttttttttttttttttgagatggagtctcactctgtcac
ccagactggagtgcaatggtgcgatcttggctcactgcaacctccatctcccgcgttcaa
gtgattcttctgcctcagcctcctgagtagctgggattacaggcacgtggcaccacacct
ggctaatttttttgtattttagtagagacggggtttcaccatgttggtcaagctggtctc
gaactcctaaccttgtgatccacccgcctcggcctcccaaagtgctgggattacaggtgt
gagccactgcgcctggccaagaccatttttttaagtcagat >IGR1270a
ctcctgagtagctgggattacaggcacgtggcaccacacctggctaatttttttgtatttt
tagtagagacggggtttcaccatgttggtcaagctggtctcgaactcctaaccttgtgat
ccacccgcctcggcctcccaaagtgctgggattacaggtgtgagccactgcgcctggcca
agaccatttttttaagtcagatttattgaagcataattaacatacagtaaaattcaccctt
ttccagggtacaattccatgtgtttttggcaaatataaacatttgtgtaaaccaccaagac
ctttttttttttttttttttttaagacggagtctctctctgttgcccaggttggagtgca
gtggcgcgatctcagctcactggaagctccgcctcccgggttcacgccattctactgcct
cagcctctgaggactgtagctgggactacaggcgcccgccaccgcgcccggctaattttt
gtattttagtagagacggggtttcaccgtgttagccaggatggtctctatcccctgacc
tcgcgatccgcccgcctcgggctcccaaagtgctgggattacaggcgtgagccagcgtgc
ccggccaccaccaagaccatttaaatgaatactgtggagacttggatatcagtaggaaga
aaaaagcaaatctacacttttacttaccactgtaag >IGR1271a
ggtttcaccgtgttagccaggatggtctctatcccctgacctcgcgatccgcccgcctcg
ggctcccaaagtgctgggattacaggcgtgagccagcgtgcccggccaccaccaagacca
tttaaatgaatactgtggagacttggatatcagtaggaagaaaaaagcaaatctacacttt
tactttacttaccactgtaagttctggtggataaaatttcagaaagatatttcgggaagc TABLE 5-continued aataaaagaagaagcaagaaatgtaattacctctacttttaaaggggaattttatgaccc
aaagtagcataagaaattagcaatcactgagataagatattgctcgtctctggtcttagc
atgaagtacccaacattatctcttatgcagttttgctttcttaaaaacgaaaaaagttg
aacttgaatctaatcataccttta gatgtaactttcagttcacggaattacaaggatta
agctaacagcaacacaggg ttggaaaaggcaaatccagaagctagaaactgttacaagac
actggcacaggctctcaggagatcattatcattaaagcaaagactattgtagattttaaa
agacttattaaaaacattttgttgcaaattaagagatttgagatacataccaccccaat
ggaatgcatggtcctagtttggaaactggttttgccatag >IGR1272a
ttggaaaaggcaaatccagaagctagaaactgttacaagacactggcacaggctctcagg
agatcattatcattaaagcaaagactattgtagattttaaaagacttattaaaaacatt
ttgttgcaaattaagagatttgagatacataccaccccaatggaatgcatggtcctagtt
tggaaactggttttgccatagatgtgtgaaggaaatttgggagataagtagggaaatttc
aatgtagactggaaattagataataaaaaattctctgaggcaggcggatcatgaggcca
ggagattgagaccatcctggctaacacggtgaaacccgtctctactaaaaatgcaaaaa
attagccgggcctggtggcatgcacctgtagtcctagctactcaggaggctgaggcagga
aaatcgcttgaacccgggaggtagaggttgcagtgagccaagatcacgccactgcactcca
gcctgggtgacagagcaggactctatctcaaaaataataataattcttgttaatttcatt
gtatttggtgtgataatattttgctatgtaagaaaatgatcttttttgagatgcatatgg
aagtattagtgatagtgtgtcatgttgtctgtaatttaaaatacttcagaaaaaaatag
tgagttgaaggaaaaaatggacatgccaaggtaaccagg >IGR1273a
actctatctcaaaaataataataattcttgttaatttcattgtatttggtgtgataatat
tttgctatgtaagaaaatgatcttttttgagatgcatatggaagtattagtgatagtgtg
tcatgttgtctgtaatttaaaatacttcagaaaaaaatagtgagttgaaggaaaaaaat
ggacatgccaaggtaaccaggttccattacaaaaaaatttcaactttgtaacaatggaaa
ctataaaactaagataaaagctctaggattggggtggaaaagatttgtaatcaaaatgat
taatccctaaaataaaaaggcaaatcagtgaagtctccacttcttagtaaactactactt
ccaaaaaatatttagtttcactggtgctaaaattaatgaaataaaaaataaaactactat
gagatactgttttatacctaatagagaacttcttttattctttgttttttgttgttgtgt
tgttgttttttgttttgagacagagtctcgctctgttgccaggctggagtgcagtgcgc
aatctcggctcactgcaacctctgcctcccgggttcaagcgattctcctgcctcagcctc
ccgagtagctgggactacaggcgtgcaccaccaagcccagctaattttttgtattttagt
agagacgggg tttcactatgttggccaggatggtctcgat >IGR1274a
acagagtctcgctctgttgccaggctggagtgcagtggcgcaatctcggctcactgcaac
ctctgcctcccgggttcaagcgattctcctgcctcagcctcccgagtagctgggactaca
ggcgtgcaccaccaagcccagctaattttttgtattttagtagagacgggg tttcactat
gttggccaggatggtctcgatctcttgacctcatgaaccaccctcccaaagtgctgggat
tacaggcttgagccgctgcgcccagcctgagaacctcttttattcttacaatactttctaa
cataattctcccttttttctgatattaatattggtacatgagctttcttttgactagtat
ggattcgttcttagaaaattgcaatttaagggaagtgaaaccaatttt atcataggctagt
tgatataaacaagagacaagttcgtagaacatattttt ggtcataaaaatatcatcaaac
ttataaataaagatgaaaacacttctattcaatatttaaacattgaaacaaatgtgagcaa
tagatacatttaagaaagattcataaaagcaagtaaaataagtatttgcccaactattcc
agttcaagtttgcaggtggctggagcttttcccatcagctcagggtgcgaggtgggcacc
aaccctgaacaggatgccattccatcacagaacacacaca >IGR1275a
cacttctattcaatatttaaacattgaaacaaatgtgagcaatagatacatttaagaaaga
ttcataaaagcaagtaaaataagtatttgcccaactattccagttcaagtttgcaggtgg
ctggagcttttcccatcagctcagggtgcgaggtgggcaccaaccctgaacaggatgcca
ttccatcacagaacacacacacatgcatgcacacacacacacacacgcagactgggac
tatgtagacatgccaattcacctcacatgcacatatttgggatgtgagaggaaactggag
tacccagagaaaccccacacagacattaggaaatgtgcaaactccacacagcctggccaa
gaattaattattgttttctcgtgaatgttataacaaagttattctaggacctgctatgta
tctttgcatccaaacttcctatgttgttttgcattgtgtatctcttgaaaatagctgata
gatgatttctaatgcaattttatagtatttgccttttaataaatgactttcatctgtttt
caattactgtgattgctggtaaatttaggcatatgtcttattcctgtgctttttctttgt
ttctttgtctcctttcctgctttgtagaatatccaagctttctttattccttgttttact
ctactgatttggaaaatacacattctatttctattcttttt >IGR1276a
ttatagtatttgccttttaataaatgactttcatctgttttcaattactgtgattgctgg
taaatttaggcatatgtcttattcctgtgctttttctttgtttctttgtctcctttcctg
ctttgtagaatatccaagctttctttattccttgttttactctactgatttggaaaatac
acattctatttctattcttttactgggcactcttaaattttt cacattactattttgaag
tccagagttaatatcattaggatccttctgaacaatacaaggactgtaaaatgtgccaga
agatcaccccccaccttccacattatcactatttagcattttt gttcctcattgtcttca
aataagaaacaaaacaaatgaaatcagttattttt aaaccagcattattcatttaggttt
accagcatatttatcaaactctttgattcccactgcttctgcgtcacttcttccttctgg
gttcattcgctctccattagcaaaacctttaaagcctggtgctaatggaccttcagagaa
agaaatatatctcctggtgctaatatcaagattaaacaaagctattttt gtgaaatgct
ttataaaattgtaaaaccctgtgaaaatataagagttatttttttctggccaggcgcattg
gctcacacctgtaatcccagcactttgggaggccgagatg TABLE 5-continued >IGR1277a
gcaaaacctttaaagcctggtgctaatggaccttcagagaaagaaatatatctcctggtg
ctaatatcaagattaaacaaagctattttttgtgaaaatgctttataaattgtaaaccct
gtgaaaatataagagttatttttttctggccaggcgcattggctcacacctgtaatccca
gcactttgggaggccgagatgggcagatcacgacgtcaacagatcaagaccatcctggcc
aacttgttgaaaccccgtctctactaaaaatacaaaaattagctgggcatgatggcgcgt
gcctttagtcccagcttctctggaggctgaggcaggagaatcgcttgaacccaggaggcg
gagcttgcagtgagctgagattgtgccactgcactccagcctggcgacagagtgagactc
tgtctcaaaaaaaaaaaaaaaagatttcttttttctgcattggatattttcagagggta
atctggtaaaatgtaacaaagctataaacatgattatacaagttcattagcataaggaaa
attttaaaattttacacaggtgtttatagtagcattgtttaaaattgtggaaggctaga
aacaaccccagtgcctaaaagttgggaaatggtgatggaaactatggtacatcagtttca
tctaatagcaggttatcactaaaataataagtaggaaatt >IGR1278a
agctataaacatgattatacaagttcattagcataaggaaaattttaaaattttacaca
ggtgtttatagtagcattgtttaaaattgtggaaggctagaaacaaccccagtgcctaaa
agttgggaaatggtgatggaaactatggtacatcagtttcatctaatagcaggttatcac
taaaataataagtaggaaattgtatagatatgtgaaaagaaatactcataaaaaagata
aatacaaactgcatatattcactgattaaaactgtaaaactgtctatgtgttggtaaggt
ttagaagatgatttcaaaaaactgatagttgctataccaagaaattctgtgttattttc
ctataatgttatttattcaattaaaaaatcatattaaagggagattgaaaggatagaatt
tcgaatagagtcaagaagaaaagagatgttatcaatttacatttagtcatcatgaaaat
tgcgaggcatcatgctcagttgattagaatcagttcatggaaaagtcatttgaccttaag
gactacacagtaaaaccacagttatcagttttaaagacatgttgccaatgtgttaccca
ctaatagagataaaagttttagggcaaaaggatggatgttacccgccaatgtaactttc
aatattaatcaaagtgcttttttttaaattataaaattacc >IGR1279a
ttgattagaatcagttcatggaaaagtcatttgaccttaaggactacacagtaaaaacca
cagttatcagttttaaagacatgttgccaatgtgttacccactaatagagataaaagttt
tagggcaaaaggatggatgttacccgccaatgtaacttttcaatattaatcaaagtgctt
ttttaaattataaaattaccaaccagtaattatttaaaaatacaattaattgttta
tttctttctatttccctaaaataacgtggattttaaaaaatctaaatggtagttcacatt
gcctccgtctctgtagctgaactttaaagctttgctctcttttgcccaggagttctgcca
aagaactcctgttgtttgttactttaggctcctagctgcaggtaaaagactccttgaggc
cgggcacggtggctcatgcctgtaatcccagcactttgggaggccgaggcgggcggatca
cgaggtcaggagtttgagaccagcctggccaagatggtgaaaccccatctctactaaaaa
tacaaaagttagccgggcgtggtggcagttgcctgtaatcccagctactcaggaagctga
ggcaggagaatcgcttgaacctgggaggcggaggttgcagtgagccgagattgcaccact
gccctctagcctgggtgacagagcaagactctgtctcaaa >IGR1280a
ccagcctggccaagatggtgaaaccccatctctactaaaaatacaaaagttagccgggcg
tggtggcagttgcctgtaatcccagctactcaggaagctgaggcaggagaatcgcttgaa
cctgggaggcggaggttgcagtgagccgagattgcaccactgccctctagcctgggtgac
agagcaagactctgtctcaaaaaaaagaaaaagacttcttgagtttccacagtatagtaa
tcctcacttaatgtcatcaataggttcttggaaacagactttaagggaaacgatgtataa
caaaaccaattttaccgtaggtgaattgatatgaacaaagcttacattcctatggcatat
ttctggccacaaaaatatcatcacacttctaaacaaagaccaaacacttctaatattaaa
cattgaaacaattatgagctatatgtacatttaagaaagattcataaaaacaagtaagat
aacttacccaactattccagttgaaggttgaagatggctggagtttatcccggtagctca
aggtacaaggtgagcaccaatcctggatagggcgtcattccattgcagagcacacagacg
cacacacagacgcacacacacactcacagactgggactgtgtagacatgccaattcac
ctcgcgtgcacatctttgggatgtgagagattgtgcaaac >IGR1281a
gttgaaggttgaagatggctggagtttatcccggtagctcaaggtacaaggtgagcacca
atcctggatagggcgtcattccattgcagagcacacagacgcacacacagacgcacacac
acacactcacagactgggactgtgtagacatgccaattcacctcgcgtgcacatctttgg
gatgtgagagattgtgcaaactccacatagacaatggctttggctgggaagcgattgttt
ttcttatcaacagtataatgaaataacgtggaactaagcaaagttattcaaggacctgct
gtattcacattaactcaacgagtacaacaaaagataaagttgttgtaagtgcctgcttgt
tcattcagttagttatttaacaaatctttatttactgtctacaataggctagtcctcaa
ggatgaagagatcgattcaataaaaaccttattctcaaggagctcatagtctactggtga
aataaaaaggtgccaactgcattacactcatggaattcaaagttctgctttttttttttt
tttgagacagggtctcactatgttgcccaggctagtcttaaactcttgggcccgattgat
cctctggcctcagcctcctgagcaaagccttttaaataataatggtaaaaacaatcatta
acttttttcaatgtgcagtattattatttatttattaatt >IGR1282a
cattacactcatggaattcaaagttctgctttttttttttttttgagacagggtctcact
atgttgcccaggctagtcttaaactcttgggcccgattgatcctctggcctcagcctcct
gagcaaagccttttaaataataatggtaaaaacaatcattaacttttttcaatgtgcagta
ttattttatttattaatttattttgaaatgaatctcgctctgtcaccaggctagagt
gcagtggcgctatctcagctcacggcaacctctgcctcctgggttcaagtaattctcctg
cctcagcctcccaagtagctgggattacaggcgccagccaccaagcctagctaattttg
tatttagtagaaacagggtttcaccatattggccaggctggtctcgaactgctgacttc
aaccaatccacctcagcctcccaaagtgctggggttacagacctgacccatcatgc TABLE 5-continued ctcgccgcagtattattttaatacactttttattttaagtagttttagatttatagaga
agtttcaagactgttagagagcattccagtgtgccctgcacccagtttcccattgttaac
attactatggtacaattgtcacaactaaggaactaatattggtacattactaaactccag
gcttttccaattcccttagttgtgcccgttgtccttatt >IGR1283a
taatacactttttattttaagtagttttagatttatagagaagtttcaagactgttagag
agcattccagtgtgccctgcacccagtttcccattgttaacattactatggtacaattgt
cacaactaaggaactaatattggtacattactaaactccaggcttttccaattccctta
gttgtgcccgttgtccttattctgttcctgagtgtcatccatgataccacattgtatgta
gtcatcacgtctcttagaggcctctctggctgtgtcagtttctcagactgtgcttgtttt
tgatgacccttaacagttttaaggagtactggtcaggcattttgtctttccatttgggtat
gtgtagtgtttgtgtcatggtaggcagaggttactggttttggggaggaagatgacagg
gataaagttcctttcttatcacatcaaatcaaaggtacatgctgttaacatgatgtttca
ctgccaccattgactgggatcacctagctgaagtagtgtttgatcaggtttctccactgt
gaagttattcctcttattctccccttcccatacagttctctttttaaaaagtcactctg
tatatcccactcttaatgaaggggttgtgttccatctccttgagggtgtagtagctac
atacattattttgaattcttgggcacaggagattaaaatc >IGR1284a
tcacctagctgaagtagtgtttgatcaggtttctccactgtgaagttattcctcttattc
tccccttcccatacagttctctttttaaaaagtcactctgtatatcccactcttaatga
aaggggttgtgttccatctccttgagggtgtagtagctacatacattattttgaattct
gggcacaggagattaaaatcattaacttttatttggagttttgcattaataaagctctt
tcttttttttgagatggagtctcgctctgttgcccaggctggcgtgcagtggcgtgatct
cagctcactgcaacatccacctcccaggttcacgccattctcctgcctcagcctcctgag
tagctgggactacaggtgccggccaccatgcccagctaattttttgtatttttagtgga
gatggggtttcactgtgttagccaggatggtctcgatctcctgacctcgtgatctgcccg
cctcagcctcccaaagtgctgagattacaggtgtgagccaccatgcctggccaataaagc
tctttcaaatacattattttacaggtccaactccgagacagtttacagtcaggttgggga
gatcacacttatagaggaaaagttaatgacacgaaaactttataagaaatttaattttgt
acacccatgttcatagcagcattattcacaatagccaaag >IGR1285a
tgagattacaggtgtgagccaccatgcctggccaataaagctctttcaaatacattattt
tacaggtccaactccgagacagtttacagtcaggttggggagatcacacttatagaggaa
aagttaatgacacgaaaactttataagaaatttaattttgtacacccatgttcatagcag
cattattcacaatagccaaaggatggaagcaacattggtgtccatcgacagaccatggat
aaacaaaacatggtatagacatccaatgaaatattattcagccttaaaaaggaagaaaat
tgacacatgctacaacatggatgaatcttgagaatagacattatgctaaatgatataagc
cagtcacaaaaagccaagtactgtatatcaggtacctaaagtcatcaaaattcataaagac
agaaagtagaagcgtggttgcaaggtgctgggagaacggggcgggggttgggagctgtt
gtttaatgggtacagagtttcagttttgcaagatgaaaagagtcctggagatttgtcaca
caacattatgaatgtacttaaggctactgagctgtacacttaaaaaaatggttaagatag
taaattttatgtgtattttgccacaattaaacatttctaaaagaaatacaattttgaata
agaagtatttttataactagccttccaataagaacccac >IGR1286a
tcagttttgcaagatgaaaagagtcctggagatttgtcacacaacattatgaatgtactt
aaggctactgagctgtacacttaaaaaaatggttaagatagtaaattttatgtgtatttt
gccacaattaaacatttctaaaagaaatacaattttgaataagaagtatttttataact
agccttccaataagaacccacagttttgctgtaaaacagaggctgcaaaatggtacatta
tacagttgccaacatttgaaaaatccagagattatatataataagcaggattcagccttt
cctttttttgttgttgttgttgttgtgcttttttgtttttttgtttgttttgttttt
gagacagtctcactctcttgcgcaggctggagtgcagtggtgcaacctcagctcactgca
acctccgcctcctgagttcaagcaattctcctgcctcagcctcccgagtaactgggatta
caggcacacaccaccgcctggctaattttttataaaggcttctttgaaaaacagaatga
tcgggtaatgtgagcccaggtgtgtcacctggcaaccatcagctggagctgagcagcacc
tgccacctttagacagatcatgcatgctatagtttcatgtgaccccaccagctttgatg
tattacaccctgcccatttcactcactggtcttgaactcc >IGR1287a
ctggctaattttttataaaggcttctttgaaaaacagaatgatcgggtaatgtgagcccag
gtgtgtcacctggcaaccatcagctggagctgagcagcacctgccacctttagacagatc
atgcatgctatagtttcatgtgaccccaccagctttgatgtattacaccctgcccatttt
cactcactggtcttgaactcctgggctcaagtgatccactgcctggcttaccaaagtgc
tgggattacaggcgtgagccactgtgtttagcccaatttttattttttctagagatgga
gtctcactatgttgcctggctggtctcaaactcctgggctcaagcaatccttctgcttc
agcctcccaaagtgctgggattacaagcatgagccacttgcccagcctcctatgataga
atttaagcactcagaactttgtgtatttaaggtactaaaataacaagttatttggcaatt
cccctgaaactttcacctaagccctaacttcctcagtgtaacataaaggtgtcaggggga
atcagagagaacgctctcatattctctgggaagagaaagctcctgccagaactcagcttc
ttttctgagaataccatttaagagcactttgaccaagcctattgtgattcctactcccg
aaaatctcactcccgatagattttctgaagtgagccaaac >IGR1288a
agccctaacttcctcagtgtaacataaaggtgtcaggggggaatcagagagaacgctctca
tattctctgggaagagaaagctcctgccagaactcagcttcttttctgagaataccattt
taagagcactttgaccaagcctattgtgattcctactcccgaaaatctcactcccgatag TABLE 5-continued attttctgaagtgagccaaacttctgcagtctcaaggaaacatttctcaaggaaaacatt
tctcaagtgcgcaaatcagacacatctaaccaagagtccaaaacttcagcacaaacaaaa
ccaaacgtggtacaagaaggccgccactgaaatccaagactgtctttatctttccagtgc
agagctgggattgagtatgtatgaaaggtgtgtctacctcccagctgcctctacttctcc
tacacaactgcacctagctttggaaaactgttctgggcaacagtttgtgtttggtaccat
ctgttcttgacgctcaagacaggcctgaagtcaggcttctaggctgcaacatagagccac
tctgggatgctcactgaagcactctattaaaaacaatgagccacatacacctccatcata
tgtgttcaggccagggaaaaggaagtgtgtgatctaggagggggcctcatttgtaccttt
ctcgggattacaggtctgagcctaaggaacaaaggctgat >IGR1289a
caggcctgaagtcaggcttctaggctgcaacatagagccactctgggatgctcactgaag
cactctattaaaaacaatgagccacatacacctccatcatatgtgttcaggccagggaaa
aaggaagtgtgtgatctaggagggggcctcatttgtacctttctgggattacaggtctga
gcctaaggaacaaaggctgattcccctaatttcatggcccgcccaaggtgtgaaaggaca
cctccacccttatgggacataaaggagaggacacatccatgtattatgtatctgtgacag
atatttattggttgccttcctagaatctgtgtccccttactactgggaccccacatttc
taagctatgcagttgaggtaggattagggtcacctctagctccagggagagccaatcagt
atatactacaccctggtcacagttcaaggatgaacatgtgacccttgtcagaaagagact
gaatttgaaagcttttgattaaacaatcagaaaagcacagcttgcttttttcctgctgctc
atgaacagaatacatanagatccaggagtctggacatcatcttgagacctcaatgggaaa
ggtgcccaaggatggagtcaaggaagagtcactgaagccatcaaaatgtaaaagagcctc
cattcctggactgtttggttctatgagccaataccttccc >IGR1290a
taaacaatcagaaaagcacagcttgcttttctcctgctgctcatgaacagaatacatanag
atccaggagtctggacatcatcttgagacctcaatgggaaaggtgcccaaggatggagtc
aaggaagagtcactgaagccatcaaaatgtaaaagagcctccattcctggactgtttggt
tctatgagccaataccttccctctttatcttcaacaactttaggttaggtttttagtcac
tggcaacagaaaggatcctaatcaagaccccagtgaacagaactcgaccctgccaaggct
tggcagtttccatttcaatcactgtcttcccaccagtattttcaatttcttttaagacag
attaatctagccacagtcatagtagaacatagccgatctgaaaaaaacattcccaatatt
tatgtattttagcataaaattctgtttagtggtctaccttatactttgttttgcacacat
cttttaagaggaagttaattttctgattttaagaaatgcaaatgtggggcaatgatgtat
taacccaaagattcttcgtaatagaaaatgttttaaaggggggaaacagggattttttat
tattaaaagataaaagtaaattattttttaagatataaggcattggaaacatttagttt
cacgatatgccattattaggcattctctatctgattgtta >IGR1291a
tttctgattttaagaaatgcaaatgtggggcaatgatgtattaacccaaagattcttcgt
aatagaaaatgttttaaaggggggaaacagggattttttattattaaaagataaaagtaa
atttatttttaagatataaggcattggaaacatttagtttcacgatatgccattattag
gcattctctatctgattgttagaaaattattcatttcctcaaagacagacaataaattgac
tggggacgcagtcttgtactatgcactttctttgccaaaggcaaacgcagaacgtttcag
agccatgaggatgcttctgcatttgagtttgctagctcttggagctgcctacgtgtatgc
catccccacagaaattcccacaagtgcattggtgaaagagaccttggcactgcttttctac
tcatcgaactctgctgatagccaatgaggtaattttctttatgattcctacagtctgtaa
agtgcataggtaatcatttgtgatggttcctttactatatatagagatctgttataaata
ataagattctgagcacattagtacatgggtgataactacatcaccagcaaacattctgtt
aaaagttatgaatgctggtgtgctgtaaaaatgattgtatttcctttcctctccagactc
tgaggattcctgttcctgtacataaaaatgtaagttaaat >IGR1292a
gtgatggttcctttactatatatagagatctgttataaataataagattctgagcacatt
agtacatgggtgataactacatcaccagcaaacattctgttaaaagttatgaatgctggt
gtgctgtaaaaatgattgtatttcctttcctctccagactctgaggattcctgttcctgt
acataaaaatgtaagttaaattatgattcagtaaaatgatggcatgaataagtaaatttc
ctgttttaagctgtaaatcattagttatcattggaactatttaattttctatattttgtt
ttcatatgggtggctgtgaatgtctgtacttataaatatgaggaatgacttttttatcaag
tagaatcctttaaacaagtggattaggctcttggtgatgttgttagtttgcctcccaaa
gagcatcgtgtcagggattcttccagaaggattccacactgagtgagaggtgcgtgcta
gtctccgtgcagttctgactctttctcactctaacgtgtttctgaaagtattagcaactc
agaattatattttttagaaccatgatcagtagacattaaaatatataacaaatgccctata
ttaataatttctgcatacttaaataattatgactatatgatggtgttgtatgcatttgaa
tatgtcctggtcatattaaaatgtaaaatatatagtttta >IGR1293a
tctttctcactctaacgtgtttctgaaagtattagcaactcagaattatattttagaac
catgatcagtagacattaaaatatataacaaatgccctatattaataatttctgcatact
taaataattatgactatatgatggtgttgtatgcatttgaatatgtcctggtcatattaa
aatgtaaaatatatagttttattagtctaaatagaataaaactaccagctagaactgtag
aaacacattgatatgagtttaatgtataatgcattacacttccaaaacatttttttccag
ttacataattaagttatatcctttataaaactcctcagtaatcatataagcttcatctac
tttttgaaaattttatcttaatatgtggtggtttgttgcctagaaacaaacaaaaaact
ctttggagaagggaactcatgtaaataccacaaaacaaagcctaactttgtggaccaaaa
ttgtttttaataatttattttttaattgatgaattaaaaagtatatatatttattgtgtaca
atatgatgttttgaagtatgtatacattgcagaatggacaatggaccaaattttttatacc
ttgtcttgattatttgcattttaaaaattttcctcatttagcaccaactgtgcactgaag
aaatctttcagggaataggcacactggagagtcaaactgt TABLE 5-continued >IGR1294a
ttaattgatgaattaaaaagtatatatatttattgtgtacaatatgatgttttgaagtat
gtatacattgcagaatggacaatggaccaaatttttatacctgtcttgattatttgcat
tttaaaaattttcctcatttagccaccaactgtgcactgaagaaatctttcagggaatagg
cacactggagagtcaaactgtgcaaggggtactgtggaaagactattnaaaaacttgtc
cttaataaagaaatacattgacggccaaaaagtaagttacacacattcaatggaagctat
atttgtctggctgtgcctatttctatggaattgacagtttcctgtaatacctattgtcat
ttttcttttttcacagaaaaagtgtggagaagaaagacggagagtaaaccaattcctaga
ctacctgcaagagtttcttggtgtaatgaacaccgagtggataatagaaagttgagacta
aactggtttgttgcagccaaagattttggaggagaaggacatttactgcagtgagaatg
agggccaagaaagagtcaggcccttaattttcantataatttaacttcagagggaaagtaa
atatttcaggcatactgacactttgccagaaagcataaaattcttaaaatatatttcaga
tatcagaatcattgaagtattttcctccaggcaaaattga >IGR1295a
aagattttggaggagaaggacatttactgcagtgagaatgagggccaagaaagagtcag
gccttaattttcantataatttaacttcagagggaaagtaaatatttcaggcatactgac
actttgccagaaagcataaaattcttaaaatatatttcagatatcagaatcattgaagta
ttttcctccaggcaaaattgatatactttttttcttatttaacttaacattctgtaaaatg
tctgttaacttaatagtatttatgaaatggttaagaattttggtaaattagtatttattta
atgttatgttgttctaataaaacaaaaatagacaactgttcaatttgctgctggcctc
tgtcttagcaattgaagttagcacagtccattgagtacatgcccagtttggaggaagggt
ctgagcacatgggctgagcatccccatttctctggagaagtctcaaggttgcaaggcac
accagaggtggaagtgatctagcaggacttagtgggatgtggggagcagggacacaggc
aggaggtgaacctggttttctctctacagtatatccagaacctgggatggtgcagggtaa
atggtagggaataaatgaatgaatgtgctttccaagactgattgtagaactaaaatgagt
tgtaaggcgtcccctggaagaagggcagtgtgggaacctg >IGR1296a
tagcaggacttagtgggatgtggggagcagggacacaggcaggaggtgaacctggtttt
ctctctacagtatatccagaacctgggatggtgcagggtaaatggtagggaataaatgaa
tgaatgtgcttccaagactgattgtagaactaaaatgagttgtaaggcgtcccctggaa
gaagggcagtgtgggaacctgtaactaggttcctgcccagcctgtgagaagaatttggca
gatcaatctcattgccagtatagagaggaagccagaaaccctctctgccaaggcctgcag
gggttcttaccccacctgaccctgcaccataacaaaaggaacagagagacactggtaggg
cagtcccattagaaagactgagttccgtattcccgggggcagggcagggcagcaccaggccgcac
aacactccattctgcctgcttatggctatcagtagcatcactagagattcttctgtttga
gaaaacttctcaaggatccagaaaatatgctctttaaaatattttaaaactgatatagac
ccaaaggagagacccagtaacaatattcagctatattatccattctctctttctttcatt
caacaaatctgtattgatcacaggctctctgctgggtgtgggatgcagctgtgggcctgt
gctggaggtccttagaggccagtactcctatcctgggctt >IGR1297a
agaaaatatgctctttaaaatattttaaaactgatatagacccaaaggagagacccagta
acaatattcagctatattatccattctctctttctttcattcaacaaatctgtattgatc
acaggctctctgctgggtgtgggatgcagctgtgggcctgtgctggaggtccttagaggc
cagtactcctatcctgggctttatctgcatggattgctgcagtgtttgggctccactgctg
tgtgaagcaattgctcctgctctttctgggcatgggagaagggtcagagcagtcggacac
agattcccaggcaggagaatggaactccttccgaggaagaagacgtgtttttccttccagc
acacacccaggcatggtggtcaggaccgtggaccaggtcccaacttgtgcatgcaccaa
gcccaggatcaggagcagagctagtgagggagcaagatggatgaggacagcacggtgct
gaccactctagacagacaggagacaggaaacaggaaactcaacttgcaaaaagactgaat
ctcaacttgattcaattaggcagatactgagttccagtatactccaggactattctaggg
gctaggattcaacagtgaataaaacagacaaaatcctttcccttgtacacttatatcctc
tcaaaaaagctcctttcccctcttcttatcagggtctaa >IGR1298a
gagacaggaaacaggaaactcaacttgcaaaaagactgaatctcaacttgattcaattag
gcagatactgagttccagtatactccaggactattctaggggctaggattcaacagtgaa
taaaacagacaaaatcctttcccttgtacacttatatcctctcaaaaaagctcctttccc
ctctttcttatcagggtctaatatagttaataaggacttaagactggaatatcacatcta
aatcccaataatgagccctcaccaatctgccaggtcccagagaagctaaaaacaatcag
ggctgtttgcaactaactgaaataaaacttgattcgaactcatgtcaagcctgttgacaa
cacacacacatgtccacgtgtcactgctgtgcatagaaacctctgactcactaccatctg
aagtccaggctccttcacaggtcattcaaggtcgacctctgcccctctgaccctgaca
tacagaaatacaggcatcatccatgtaacaaccttggcaagaaacattaaccaggtgcc
tcattcccattattttaagtgcgaaaattttaatgcattatgtctcaacccaaaatctt
caaccaacttcttaaaacataaaacatagtaaaatgcctgtatataaggaaaaaacacat
tagggtgtaaaaatttaaacaaaatattttgtatttattt >IGR1299a
tccatgtaacaaccttggcaagaaaacattaaccaggtgcctcattcccattatttttaag
tgcgaaaattttaatgcattatgtctcaacccaaaatcttcaaccaacttcttaaaaaca
taaaacatagtaaaatgcctgtatataaggaaaaaacattagggtgtaaaaatttaaa
caaaatattttgtatttatttatttaattgtagtaaaataaggatataagatatttaaaa
cagtacttcctgatcactcagcagttaatataatggttgctttgtctgtataacatgctg
cacgtcccccttagttaacattcagagccttttccgattgtcttctgtgaacgctgatttgc
tactaatcatatgtggaataaacctaaagactttgtccattgactcccctcatcacttgg TABLE 5-continued ttaaagaatttcttatgtttaggggacataaatattttttacaatataaatattggtggga
aagcattgtattgagagacacgttctatgaagaagaactgtatgtggaaaacatttattg
tggagatgttcaggccaggcatggtggcttatgcctgtaatcccagcactttgggaagct
gaagcaggaggatcacttgagtccaggagttcaagactagcctgggcaacatagcaagat
gtctctacaaaaagaaagaaaagtagccaggcgtggtggt >IGR1300a
acgttctatgaagaagaactgtatgtggaaaacatttattgtggagatgttcaggccagg
catggtggcttatgcctgtaatcccagcactttgggaagctgaagcaggaggatcacttg
agtccaggagttcaagactagcctgggcaacatagcaagatgtctctacaaaaagaaaga
aaagtagccaggcgtggtggtgcacatctgtagttccaactactcaggtggctgaggtgg
gaggatcacctgagcccaggaggtgaggctgcaatgagctctgattgtgccactttgggc
aacagtatgaggctgtttaaaaaaaaaaaaaaaaaacaaaaaaacaaagagatgatctgta
aagaatgctagctcttattcttcacagaatatccatgaattttcatacctctgtgccttg
gtccacactatacctgtctcagtatcttttttctttcccacccaacaaacttgtaat
tgcccttagatgtttcattcaccatatcctccttcttttttttttttagagacaggg
tcttgctctgtcacccaggctggaatgcagtggcgtgatcattgctcactgcagccctga
actcctgggctcaagtgattccctgtttcagcctcccagtagctgggctacaggcac
ttactaccatgcctagttaatatcttttaaaattattttg >IGR1301a
ttcaccatatcctccttctttttttttttttagagacagggtcttgctctgtcacccagg
ctggaatgcagtggcgtgatcattgctcactgcagccctgaactcctgggctcaagtgat
tcccctgtttcagcctcccagtagctgggctacaggcacttactaccatgcctagtta
atatcttttaaaattattttgtagggatgggtttcactatgtgacctgggttggtctta
aacttctggcctcaagtgatcctctcactctggcctctcaaagtgctgggattacaagta
tgagccaccacactgccctcttttattttttatttattttatttatttattcatttattat
tttttcgagatggagtctcactttgtcacccagcctggagtgcagtggcatgatctcgg
ctcactataacctccacctcctgggttccagtgattctcctgcctcagcctcccgagtaa
ctgggactacaggtgcatgccaccacacccagctaattttttatatttttagtagagacag
tgttttaccatgttggtcaggctggtcttgagctcttcacctcaagcaatccacctgcct
cagccttccaaagtgctgagattataggtgtgagccaccgtgcccggtcttttttatttat
ttattcattcatttatttatttattttttgagacagagtg >IGR1302a
ccaccacacccagctaattttttatatttttagtagagacagtgttttaccatgttggtca
ggctggtcttgagctcttcacctcaagcaatccacctgcctcagccttccaaagtgctga
gattataggtgtgagccaccgtgcccggtcttttttatttattcattcatttattta
tttatttttgagacagagtgtcactctgtcacccatgctggagtgcagtggcatggtct
cagctcactgcaagctccgcctcccaggttcatgccattctcctgcttcagcctccctag
cagctgggactacaggtgcccaccaccacacctggctaatttttttgtatttttagtaga
gatgggtttcaccatgttagccaggatggtctcgagctcctgacctcatgatctgccca
tctcagcctcccaaagtgctgggattacaggcatgagccaccgtgcctggactgttttta
ttttttaagagatagagtcttgctatgttgtccaggctggacgcaaactcttgggttca
agtgatcctcccatctcaccctcctgagtaattggaactataggcaagtgccaccatgtc
cagcagtttttttaatctcaatgtacctgcctgtggccagctgacctactgctttcatgg
tctcatatcattgtgtacatttaccatcaggatcacgaca >IGR1303a
cttgctatgttgtccaggctggacgcaaactcttgggttcaagtgatcctcccatctcac
cctcctgagtaattggaactataggcaagtgccaccatgtccagcagtttttttaatctc
aatgtacctgcctgtggccagctgacctactgctttcatggtctcatatcattgtgtaca
tttaccatcaggatcacgacatagagagagtaaaatgcacaggcctataaatgtaacgag
ctgttacaaaagtttcaaagccacaggaaggttctaccaggtgcttagaaatgtttattcc
atttatacaaaaagaactagaaaaacagttccagagtataaaagactcaagcctaggag
tctccatgtttcacttgtccgatggaagtcccattcttaccaaagaatcatggcagattt
aggttttcctggtgtcagtattagctcagacctcatatttaacaatgtttgaaaagtttg
ggtatctcctatactagtgtgtacttatcctgatgaatggctccagatggctttagtaaa
ggattaaagaaagtttactgcatgtatatgtagtgggattatagagtcctcctgttcaat
caatggacactgggtttatgaatgccttagatgtgggaactggaggaagagcttgcattt
ccactgtggtggctgatgtcagccctttaccacttgatta >IGR1304a
tgtacttatcctgatgaatggctccagatcgctttggtaaaggattaaagaaagtttact
gcatgtatatgtagtgggattatagagtcctcctgttcaatcaatggacactgggtttat
gaatgccttagatgtgggaactggaggaagagcttgcattccactgtggtggctgatgt
cagcccttaccacttgattacatatacatgctaattgattatcaacgtttcttgtctct
aggaacactttaatttcttagccaccacaatagatccctgaaggttaagagtcaaggcac
cctggttggcaccatgccttgctgttttgtggtggtaattatgtccccttgcctctaat
gtttaagtgcttccaacctgagctctgccattctagggatctcatgttgcctattgatat
tagggagtccatgtcattggcagcatctttcaccttcaacccagcttacaggggacatcc
accaccaatgtttgcaatgatgcctgcttctcttcactagtgtatctgttgctgtgttag
taaaaggagtatattctgtgtcctccaggaacatactcagatagtaggttctcaggccag
atacaaaaaatccattttagtattcctgcttctctgagctatctgctcttttcttcaata
ctatgggaggaagttcaggtgtctccacttcatattctgt >IGR1305a
atgcctgcttctcttcactagtgtatctgttgctgtgttagtaaaaggagtatattctgt
gtcctccaggaacatactcagatagtaggttctcaggccagatacaaaaaatccatttta TABLE 5-continued gtattcctgcttctctgagctatctgctcttttcttcaatactatgggaggaagttcagg
tgtctccacttcatattctgtacaccatcatcaggatcaggcttcaaggagccactccag
caaactattaggactaactccagttgttcttgcgaaaacttaattctgagtcgtaagtat
acccacaccaataaatccaatcccattcaactctatattcttctggacaaacagctgcag
gatgcactcgattctggattctgacagtacatattagtaaactcctgcacaccttacact
tccctgccaagactgtatgtcagctgtgaagctattgtctctcagcttcaagcccactat
actatactctgctgcagctgggattctgcaaaccaatttctcctttgccagctgcaaccc
tgttaggatctgtcaatggagggtgtagactaggaggctggaggaagaaaaggggactt
tttcttcctgttgcttcctattctttgttttgttcctgttcctgtcctcttatattcc
tattcctaatcctaatcctaacatgaaccctggcagcagt >IGR1306a
gggattctgcaaaccaatttctcctttgccagctgcaaccctgttaggatctgtcaatgg
agggtgtagactaggaggctggaggaagaaaaggggactttttcttcctgttgcttcct
attctttgttttgttcctgttcctgtcctcttatattcctattcctaatcctaatcct
aacatgaaccctggcagcagtagttgactctagtagcaacatttgattatagtttgcagt
ttttccaccattcatagaaccgaccttagcacacctcatttccctctgagacccccagcaa
cagccaatcagcatcccctcagaggtctggatcccattcccaaaggaccccttttctgag
ctcaggaactgcactgcatgcagagcagtgtcccctctacagatgtctgagtttcaggtc
cacaaagcccgtcctccaaatttataagttttaataattttcacctgttcccttttgcttc
ccagacatagaagtgctagctgcttcccacaattgccacctccttgatacccttattgttc
cctttttgcctgcctagttttccaatacctggctaacagttctttatatttaattctgct
tattaaaataactggtatagtttgtgtctcctggttggtgcctagttaacacaagatgtt
cttagatctgactttaattattggccttgaggcaataagg >IGR1307a
ctgcttcccacaattgccacctccttgatacccttattgttccctttttgcctgcctagtt
ttccaatacctggctaacagttctttatatttaattctgcttattaaaataactggtata
gtttgtgtctcctggttggtgcctagttaacacaagatgttcttagatctgactttaatt
attggccttgaggcaataagggggtgttgagggagggttgtgggcagaacaaatgtcatct
tgtgaagtatatgtttcaagtgaaatagttattctgtttccaggcaaggagaagttagtc
tactctggcaaggggaaaggtctgcttctaccagttaaggagggctcagagaatttgga
ggttcaagagttttaggtttgtccacccaaatgtttctatcccaggtctcatggtcccag
cctttcctcataagagccctgactttgacacagaatgtgcaaaatccactcttctccttt
gaagctcttcaaaggctgcaaataatcagatcctgagcctaattttcagatcggtttgcc
ctgcagttgctggaaataagagtctcctctaaagttgccatgggagttgtcgagcattcc
gagaatatgttaagttagaattagattgccatgagcctatcattttcttttggtaaggtc
ttcagtgctgtcagaagagtcattgtactctgcaatctttt >IGR1308a
aaataatcagatcctgagcctaattttcagatcggtttgccctgcagttgctggaaataa
gagtctcctctaaagttgccatgggagttgtcgagcattccgagaatatgttaagttaga
attagattgccatgagcctatcattttcttttggtaaggtcttcagtgctgtcagaagag
tcattgtactctgcaatctttataattaccattgttctcatataaccctgtcattttatc
tttcattgtcttgctgtccacctgcccctcatctaaattaaccagagctaaaagcttaag
aaattgcaaagccactgcctgccagaagttattatcaacctacttatattcagcaatagg
ttcatattattttaaaatagtgaataatccaatgtcaatgttccatttccaagtgtttgt
tacctaaaactacatctgatactaattgtcatagccaggtctcttcagaaagcagagcct
gaagtcaggctctgcttgccttctatgcctggaaattaagggtgctgtgttggtgttggt
gctgacaaagagacagataggaggcagtgagggcaatctgagaaggcacacaaatatgta
tccaatacaaacataaatttccacaactgatgcaagaagacatagaaaaatctaaacaga
tctagaaccactaaagaaattaaaccagtcatttaaaatc >IGR1309a
cttctatgcctggaaattaagggtgctgtgttggtgttggtgctgacaaagagacagata
ggaggcagtgagggcaatctgagaaggcacacaaatatgtatccaatacaaacataaatt
tccacaactgatgcaagaagacatagaaaaatctaaacagatctagaaccactaaagaaa
ttaaaccagtcatttaaaatctcttcttgaaagaatacaccaagtccagatagttttctag
gtgagtccttctaaagtgtcaggtcacatataattccaaacatatataaactcttataga
aaataaacaaaatgagatatttcccagctcattttgtgaagctaatatgtagcatacgaa
agtcagaggaggaaaatatatgaaagaaaaattatgatcccatactcactcatgatgtg
gacataaacattgttatcaaagttttataaatccaaatccagcatgtataaaaagacatt
acataacaactaatgtaatgtctttctttcaggaatataaaattaagtgtcaggaatatg
aaatattcctttatttcaggaatataaaattaaatgtcagaaaatctattaatgtaattt
accacattaatcacttttaaagagaagaatcaggctgggcacagtggctcacgtctgta
atcccagcactttgggaggccgaggcaggtggatcacctg >IGR1310a
gtctttcttcaggaatataaaattaagtgtcaggaatatgaaatattcctttatttcag
gaatataaaattaaatgtcagaaaatctattaatgtaatttaccacattaatcacttttt
aaagagaagaatcaggctgggcacagtggctcacgtctgtaatcccagcactttgggagg
ccgaggcaggtggatcacctgaggtcaggagtttgagaccagcctggacaacatggtgaa
accctgtctctactaaaaattccataattagctgggcatggtggcgggcacctgtaatccc
agctactctggaggctgaggcagaagaatcgcttgaacctgggaggcggaggttgcagtg
agttgagatcgtgccattgcactccagcctgggtgacaagagcgaaactcagtctcaaaa
tacaaaacaaaaagagagagagagagagagaagaatcacatgatgatatcaatgcgaaa
aaagcattactgaaattttacattcatttattataattacttttttaacaaagtcaaaata TABLE 5-continued gaaaggaacttttttaacctgataaacttacagaaaatactgtgctcaatggtaatatgt
tcaaatcatctctttaaaaaagaataatgcaagaatacctgcaggaccactctgtgcac
tgcacaatcccaggaagcaccatttacatcagagacatta >IGR1311a
acattcatttattataattacttttttaacaaagtcaaaatagaaaggaactttttttaacc
tgataaacttacagaaaatactgtgctcaatggtaatatgttcaaatcatctctttaaaa
aagaataatgcaagaatacctgcaggaccactctgtgcactgcacaatcccaggaagca
ccatttacatcagagacattatatatttgagtatgtatgacaatttcataccagatagaa
gtatcttttttccaatttgcacagaggctttatatgatgtactagtgtccctggagactaa
ctttgtttccattaaaaactgaccaaaggtcccagcctttgcaaaaagatcattcatatt
aatagaactaataaatatgaggattataaaggaagaaacaaaaatcatatatatatttgc
agatgatacactatgataaaaatggaactcaaaaacacgtagagtcagtcaaatgattat
aaggaataagagagttcagcaagttgctggataaatatgcaaatcaattacaaattata
cattaccaaaaaacagataatgtaattttaaagaagacatcattacaaataagtataagc
attattataatacttataagactataaagtgccaaagggtatgggggcacgtgcttgtaa
tctcaactacttgggaaaggctaaggcaggaggatcattt >IGR1312a
caagttgctggataaatatgcaaatcaattacaaattatacattaccaaaaaacagata
atgtaattttaaagaagacatcattacaaataagtataagcattattataatacttataa
gactataaagtgccaaagggtatgggggcacgtgcttgtaatctcaactacttgggaaag
gctaaggcaggaggatcatttgaggccagaagtttgaggctgcactccagcctaggcaac
tgagtaagaccccatctctctctctctaaaagaaaaaaaaagaaatgtaaagtgccaaa
gaataaatctaacaaaacatggaaaacatttaaaaacttttatgaaagatagtaacaacag
caaatgcagagacctagtatgtccacggatcaagacttgacactgtaatttgcaaactga
tttatacatttaatgtgactcctatcaaaatcccaagcatttttttcatgatcatactat
gctgattctaaaatgtacacgggaaaatgagagtccaagaatagccaatacaattctaaa
gaaggagctgaaaatgggagaacgtggccgggtgtggtggctcacacctgtaatcctagc
actttgggaggccaaggtaggcagattgtctgagctcaggagttcgagaccacaatgcgc
aatattgcaaaaccccatctctagtaaaaatccaaaaaaa >IGR1313a
cgggaaaatgagagtccaagaatagccaatacaattctaaagaaggagctgaaaatggga
gaacgtggccgggtgtggtggctcacacctgtaatcctagcactttgggaggccaaggta
ggcagattgtctgagctcaggagttcgagaccacaatgcgcaatattgcaaaaccccatc
tctagtaaaaatccaaaaaaattagctgggcgtggtggcatacacctttagtcccagcta
cttgggaggctgaggcatgagaatcgcttgagccggggaggcagaggttgcagtgagctg
aggttgcaccactgcactccagcctgggcaatagagtgagaccctgtctcaaaagcaaac
aaacaaacaaacaaacaaacaaacccaaatgggagaacttgtcttgctaga
tatcaagccttaataattaagtgtggttttgacaaggggttataacagtagtttcccaaca
gagggtgattccccaacccccaagggaacatttggcaatttgggggttgtcagaattggagg
ggaaggaggggatgctactggcatctactgggtagaggtcacggatgctgctaaacatcc
tacagtacacacaacagccctccacagcagaattctcccatccaaaatgtcagtagtggc
agggttgagaaatcctaggggtagacagatagaccggtga >IGR1314a
caagggaacatttggcaatttgggggttgtcagaattggaggggaaggaggggatgctact
ggcatctactgggtagaggtcacggatgctgctaaacatcctacagtacacacaacagcc
ctccacagcagaattctcccatccaaaatgtcagtagtggcagggttgagaaatcctagg
ggtagacagatagaccggtgaaaaactaatttaaaaacagaaaatatgacctgggagtgg
gcttatccagcaggaaacagtagggacactcatattgagtaacttaaggcagtttattta
ataaagggaccattataaaagaacagagtgtagggaaaacaaagcccttggcgactggta
acaggaactgcaacaggagaggggactatttactgaaactcaagatacagcacacaga
gatacagagcactacagcgatacagagcactacatgcagacggccaattggcaagagctg
ggaccttaagtcaagggacacaaccagcttgcagcaaccttgcaaggagagagctaaggg
catacataccttgcttcacgcacctcctacctttttgatcacctgtcaatgctcccatggt
caaacccaatgggaacctgtgggcaaataagctattaatgtagttcatactggtcagcct
cccaggacacagaggctaaaggggtggagagcagatct >IGR1315a
acaaccagcttgcagcaaccttgcaaggagagagctaagggcatacataccttgcttcac
gcacctcctacctttttgatcacctgtcaatgctcccatggtcaaacccaatgggaacctg
tgggcaaataagctattaatgtagttcatactggtcagcctcccaggacacagaggctaa
aaggggtggagagcagatctggagaggcaaataggagctttccagatggaatggaagga
tttcataaataaaaccccaaagagcagagccaaggaaaagactgatacattcaatat
tcatcaaatttaccataaggagagtgaaaagacaaaccgcaagctaggacaaatatttgt
ttcatatataaatgactaaggattagtttcaagaatgtctaacaaaatcctcttaatcag
taagaaaaagataaattacccactagaaaaaaaaaggtaaatgacatgaataagtatt
cttagaacaggaaacacaaatggccaataaacatataaagagatgttcaaccttattagt
agtcaggaaatccaaaattaaaccacagtgagataacatttcacacccaccagactggc
agaaattaaaaagtcagacattacaattcttgcccaggatgtaaagtaaaaggaattctt
acacattgtccacaaaagagtaaaatggtacttttgaaat >IGR1316a
atggccaataaacatataaagagatgttcaaccttattagtagtcaggaaaatccaaaat
taaaccacagtgagataacatttcacacccaccagactggcagaaattaaaaagtcagac
attacaattcttgcccaggatgtaaagtaaaaggaattcttacacattgtccacaaaaga
gtaaaatggtacttttgaaatgtagttcttagtaaaaaattgaacgtgcacgtaccttat TABLE 5-continued gaccccgaatttcaacctagtgcatattctagggaaattcttgcccatgaacgtcaggag
agataaacaaccacaatcatagtagactgttttcttaaataaacttattttaggaaaact
ttcaggtttacagaaaaatggggaagatagtacagaaagttcccacgtactccatatcca
attttccctattcttaacatctttcttttttttttttttttttttttagacggagtgtc
cctctgtcactcaggctagagtgcggtggcacaatctcagctcactgcaatctctgcctc
ccaggttcaagcaattctcttgcctcaacctagctgggattacaggcatccgccaccgtg
ccctgttaattttgtattttcattttttagtagagatggggtttcaccatcttggccag
gctggtctcgaactcctgatctcatgatccaccacctcgg >IGR1317a
agtgcggtggcacaatctcagctcactgcaatctctgcctcccaggttcaagcaattctc
ttgcctcaacctagctgggattacaggcatccgccaccgtgccctgttaattttgtatt
ttcattttttagtagagatggggtttcaccatcttggccaggctggtctcgaactcctga
tctcatgatccaccacctcggcctcccaaagtgctgggattacaggtgtgagccacagca
cccagtccttaacatcttacattagtatgctatacatgtcacattaatgaatcaatatgg
atgcattattgttaactaaagtccatatcttattcagatttctttagttttacttacttt
ttgcagcatgttcttaacaactaaaacttttaaaaccccccaaaatgggccaagagcagtg
gctcacgcctgtaattccagaactttgggaggccgaggtgggcagatcacctgaggtcag
gagttcgagaccagcctggccaacatggtgaaagcccgtctctactaaaaatacaaaaaa
aaaaaaaaaattagctaggcatggtggcacatgcctgtaatcccagttactcgggaggct
gaggcaggagaatcacttgaacacaggaagcagaggttgcagtgagccgaggcggcacca
ttgcactccagcctgggcaacaagaacaaaactccatatc >IGR1318a
ccaacatggtgaaagcccgtctctactaaaaatacaaaaaaaaaaaaaaaattagctagg
catggtggcacatgcctgtaatcccagttactcgggaggctgaggcaggagaatcacttg
aacacaggaagcagaggttgcagtgagccgaggcggcaccattgcactccagcctgggca
acaagaacaaaactccatatcataaaaaaaaaaaaaaaatctgcaaaatgtccatcagta
ataaaatagataaataaattatggcttactcatttagaagattataagtaaataca
gtaaataaataaactacagttatatgtatcaacatggatgagtctgaaaacattttgttg
accagtaaaagcaaatattaaataaatacatccaacatgattccatttataaagagggca
aaaataggaaaaatgaaatcatatataattagaggatatttatatatataataaaacaag
aataacaaataaatgattaaccaaaaaaataaggataatggttcccttttggtggggaggg
acatggaagctgttggagggacaccttcatgggggagagggaatgttcccttcagttgggt
ggtggacacatgggttttttgttatgttttaaactatacatagagattgtaattttttgt
atgtatgatgtttcataataataattttaaaggctctgat >IGR1319a
accaaaaaaataaggataatggttcccttttggtggggagggacatggaagctgttggagg
gacaccttcatgggggagagggaatgttcccttcagttgggtggtggacacatgggttttt
gttatgttttaaactatacatagagattgtaattttttttgttatgtatgatgtttcataat
aataattttaaaggctctgatccctgctcttttctttcccttgaaagcaggttgtctaa
atagtcctcatcctccaacattctggcttaagggaaaaggtgacactttagagtcagagc
aaacaggaaccccagccctctgtgccccaaccaaagaaatgtgattatgtctcttatcat
cttcttcaagccccaccacacatcatgatgcttcctgtttctcagaagctgaaaaaggtg
ctgacataatgtaatgagtagaatcgaggcagtatacacggatctacccagagccatgtg
tgtcacccgaggggcaggttggactctcagctgtggttgggaacataggccaaatctctg
cctttaggtgggaaatgaccccaaatttgaagattcatggagcagggtgactcttgctgt
taagaatgagagactcaccgtcatcagccccaagagatgccttctgcaacagcgaaaagc
cacctcttggcagatcccttttacgtgggtacagctggact >IGR1320a
tggactctcagctgtggttgggaacataggccaaatctctgcctttaggtgggaaatgac
cccaaatttgaagattcatggagcagggtgactcttgctgttaagaatgagagactcacc
gtcatcagccccaagagatgccttctgcaacagcgaaaagccacctcttggcagatcccct
ttacgtgggtacagctggactgggcactgggatccagctggggcctgggaaactgccaca
ctggcaccccctattcctccacagtcatccctcacttgtctgttcatttggttgtttatt
cattcactcagcaaatactcacacagctgcaatgtgccaggcactgttctaagtattggt
ggcacagcagggagcaggacatagccctgctctagcagcatcatacacatttaggagggt
cagacaacaaacaaataaaacaactataaattgtggtaagtgccttcagtgcaagtagta
gaagcaaaacaacccagtgttaagatgctaaagtcaggctacctggntttaagttctgct
tctactgctacctgccattgggcaagttaattaatctttctaggagtcanttttcctttc
tatagattggaagtgatcatcaaacctactgaataggattgattgaagatttattctttc
caaaaatatttattgagcaccactatgtgccaggcaccat >IGR1321a
ttaagatgctaaagtcaggctacctggntttaagttctgcttctactgctacctgccatt
gggcaagttaattaatctttctaggagtcanttttcctttctatagattggaagtgatca
tcaaacctactgaataggattgattgaagatttattctttccaaaaatatttattgagca
ccactatgtgccaggcaccatgccaggcactaaggattaatagtgaaggtgacagacaag
gttctgccctccaggaacatacatgatagcagaggaagagtcactggacaagcaaaggcc
atgtcggatgtgataagggctagggactaacgtgatccagggagattcaggaagtgccag
ggagagagggccactttatatgtctgacaaggtgacatttgagagctaaatgatgaaaag
gagccatctatgtgaaagcctgggggctggcgatagttaaacagagggacagcaagtgtg
aaagtatagtagcaggaatgaagttggtgtggttgaagaacagcagtaaagcacagatggct
ggagcacattagcagggaggtaggagatgaggctagggagggaagagagggctcatgcag
actcatgcaggccagagaaaggactttgcatttcattctagtaatgggaagtccctgagg
gtttaaagcagaggagggtcagatgacttacttttttttt TABLE 5-continued >IGR1322a
gaagttggtgtggttgaagaacagcaggaagacagatggctggagcacattagcagggag
gtaggagatgaggctagggagggaagagagggctcatgcagactcatgcaggccagagaa
aggactttgcatttcattctagtaatgggaagtccctgagggtttaaagcagaggagggt
cagatgacttacttttttttttgagacagggtctcactctgtcatccaggctggattgca
gtggcaccatcacagctcactgcagcgtcaacctcctgggctcnggtgatcctcccatct
cagtctcctgggtagctggcactataggcatgtgccaccacgccaggctaatttttgtat
ttttgtagagatgggatttctccatgtttcctaggctggtctcaaacttctgggctcaa
gcaatctgcctatgttggcctcccaaagtgctgggattacaggtgtgtgccactgcaccc
ggcaacttacatttttaaaagatctctagcttttgtgtgggcacagattaggttgtaatg
ttcgaccagagaaacaagttaggatgctattgctccatggtgagtgacatggttatacag
ggtgaatggtgcagggtgggctggaggagaagacagaatcctacagtgcagggcattgta
gtgggcatctgatctctctcttctcccacctctatgcagc >IGR1323a
agatctctagcttttgtgtgggcacagattaggttgtaatgttcgaccagagaaacaagt
taggatgctattgctccatggtgagtgacatggttatacaggggtgaatggtgcagggtgg
gctggaggagaagacagaatcctacagtgcagggcattgtagtgggcatctgatctctct
cttctcccacctctatgcagctgcttctctctcctcagaatccagacccaaattttacct
tctgctgggaaagccttccttccctatttttttgtttgcaggtggcgggggcncctggac
ctgggattcccacgttcttcctcctaacttgctgcctcgtggcctagaccctcttgtg
taacacagacatcagtcaggctctctcaggctcctaagacctggacgacaggctcaagct
cctatttgctcacgtgcaagtggaaagcttttgccagggtgtttgcaagttcccttgtgc
atgactgtgcatgactagcactgactctctcctgatacagcatggttagatctgtgtgtg
gctcatcaggacattcaanaagtaatgcccctgttctgcaccccacagaaggcagtcctt
tccactgagtcccattcacacagccaagctgaccatcacccggatctgcctgtggcagaa
gcaacttcaaagtgagcgctagtgctcctattcttgaagt >IGR1324a
actgactctctcctgatacagcatggttagatctgtgtgtggctcatcaggacattcaan
aagtaatgcccctgttctgcaccccacagaaggcagtcctttccactgagtcccattcac
acagccaagctgaccatcacccggatctgcctgtggcagaagcaacttcaaagtgagcgc
tagtgctcctattcttgaagtcctgtggtcacgctacagtgatagaacttcttcttcttc
accccctttccattctgtctgcagctttgtgccatcttgccagttcccctctctcttca
cccaattgcagtttatttctaatacacagagcaatttctgtagccctttttgtaacaattc
attgctcacctatggacccaagatctcagcttcctacctccctctagtggctgatgcagg
tatttccaaaaaaaagtcctagagcaggatcctggctggccacacggctgtccagtgct
gctcctgcccacaaggttctaagaggttaaggcttgacatatcagaaaaggaaaggaagc
ctgtgtgacacagaagcctgggttgagggaggctacgctctgtgtactgtccccgggcag
aggcggttttctgggtcacctgcatgtcccaacaccggcctctggtggtcggcagatgtt
aatcctaaaaccttctgtccccacctcagaggtgaagta >IGR1325a
taagaggttaaggcttgacatatcagaaaaggaaaggaagcctgtgtgacacagaagcct
gggttgagggaggctacgctctgtgtactgtccccgggcagaggcggttttctgggtcac
ctgcatgtcccaacaccggcctctggtggtcggcagatgttaatcctaaaaccttctgt
ccccacctcagaggtgaagtacctgtgcactagccttccccgtctgggtcccccaaggcc
cccacactgggcgcacagggtacagggaggagccaagccntctgctccagttctgccttc
tgcgcaggagcccctttgacttctgggagtcaaccccagctcacccaacaaggagataggg
caggtgggagacacccctaagctcagaaggcctacaggagatggagagcacccatcctcca
cctctactccttctccagaccactccacacctcgcagcttcttgctcctcaccctcgcat
ttggcccagtgggcaccaagaacaagncagggtgactggctaagctggggccaaactcac
tgacagaattggaattgtgtcaaaacaccacttttatgtcctcacctttcaggcctgcat
cagtgtgagctctgcagagaaaggggcctgtcttactgaaccctcagatcccagcacgct
gctgtcctatggaggcatccatgcatatcagcagcagaat >IGR1326a
gaacaagncagggtgactggctaagctggggccaaactcactgacagaattggaattgtg
tcaaaacaccacttttatgtcctcacctttcaggcctgcatcagtgtgagctctgcagag
aaaggggcctgtcttactgaaccctcagatcccagcacgctgctgtcctatggaggcatc
catgcatatcagcagcagaatgaatggatggagggaggaatgaatgtaatgaatgctgct
ccttcactgccacctgccttctcaccctgccctcgagggcagaatactatggcttttct
tttcttcttcttcttctttttttttttgatgaggtcttgttctgttcccaggctgg
agtgcagcagtgtgaacagatgcatggctcacngcatcctccacctcccagactcaagtg
atcctccttcctcagcctcccaagcagctgggaacaaaagtgtgtgccactatacctggc
taattttttagcttttgtagaagggtctcactatgttacccaggctggtctcaaactcct
ggcttcaagccatcctcccaccttggccttccaaagtgttgggattacaggcgagagcca
ctgtgcctggcttgctatggctttttagagtttctcacccaattacctcctctactcaat
ttctagctcccattttggttcctccatggccttttgtccc >IGR1327a
gaagggtctcactatgttacccaggctggtctcaaactcctggcttcaagccatcctccc
accttggccttccaaagtgttgggattacaggcgagagccactgtgcctggcttgctatg
gctttttagagtttctcacccaattacctcctctactcaatttctagctcccattttgg
ttcctccatggccttttgtccccaaatctgcccttgttgtcagagcactggactaggagt
caggagtaccaggtttgtcatcagttagccctttgtgtctcatggcccccatctgtaaact
ggaatgggttttctcttgatctcaggatgtaagtgggatggaaagtgcccaatctcac
ttaagactgtggtttcctgacccagagtttcagttctgtcttttcttttcagtatcagg
agtgttacatgcctgttatcctaaacacacactcacactcataaaggtataaaactgagt TABLE 5-continued cctcccagaagtattatctgtcagtttgggtatctgttgttatgttacagatgattccttc
actccttacaccaaccctggcagttgggtatgtggattacccatgtgtattagttcattc
tcacactgctataaagacatacccaagactggacaatttataaaggaaagaggcttaatt
gactcacagttacacatggctggggaggcctcaagaaaca >IGR1328a
gtcagttgggtatctgttgttatgttacagatgattccttcactccttacaccaaccctg
gcagttgggtatgtggattacccatgtgtattagttcattctcacactgctataaagaca
tacccaagactggacaatttataaaggaaagaggcttaattgactcacagttacacatgg
ctggggaggcctcaagaaacaatcatggaagaagccaagagagaagcaaaggcacgtctt
acatggcagcagaccagagagaccgcaaatgggcgaaactggaacagcccctataaaac
catcagatctcgtgagaactcacttactatcacgagaacagcatggggggaaacctccctc
tgatccaatcacctcccaccaggttccaccctccacaggtgaggattatgggaattacaa
ttcaagatgagatttgggtgggggcacagagccaaaccatatcaccatgtttcatatgaa
gaaagtgggaattagagaggccaaggaacttgcccaaggtcacatgctgggaatggtagg
ctgcggtaccgcaggaagacataagatgaaatgcatgaagaacattctgaaaaaagtgaa
attttctccagtgcttggctttatcgtgagctgatcttgtgatttctgtcactcaggctg
tggatgcaagttaaaaagcatcagctgtaaccagtcacag >IGR1329a
gccaaggaacttgcccaaggtcacatgctgggaatggtaggctgcggtaccgcaggaaga
cataagatgaaatgcatgaagaacattctgaaaaaagtgaaattttctccagtgcttggc
tttatcgtgagctgatcttgtgatttctgtcactcaggctgtggatgcaagttaaaaagc
atcagctgtaaccagtcacaggaggatttctgagttgggctggggtaggggagagagatt
tctgctttgggtccccatagtttctgtaactctggtttagtttccttgtcactggatcct
gcattccttgagggcagccattgtattttatctttcagctttactaaagtatatgaaaag
ccgggcatgctaaagtgtacaattcaataagtttagaatgtgtattcacctgtgaaacta
tcagaacaatcaagatactgaacacattaatcacctccaaaatgtcctcatgccttccag
caatcccttcttcccaggcaatcactgacctcgtttccgtcactatagattagttggcat
tttctagaattttataaaaatggaatcatagtctagtttctttctttctttcttttcttt
tcttttctttttttttttaagagtcttgttctgttgcccaggctggtgtgcagtggcg
caatgttggctcactgcaacctctgtctcccgggttcaag >IGR1330a
aatcactgacctcgtttccgtcactatagattagttggcatttttctagaattttataaaa
atggaatcatagtctagtttctttctttctttcttttcttttcttttcttttttttttt
taagagtcttgttctgttgcccaggctggtgtgcagtggcgcaatgttggctcactgcaa
cctctgtctcccgggttcaagcaattgtcctgcctcagcctcccgagtatctaggattac
aggcgcgtgccaccatgctggctaattttttgtattttagtagagacagggttttgcca
tgttgtctagactggtctcaaaccctgacctcaggtggttagcctgcctccggcctccc
aaagtgctgggattacaggcgtgagccaccgtgcccggccagcctgccttcattgacttg
gaataattattttgagacgtatccatgt >Rad50ex15
tacagcttatttcatactctcctactgttcaaaatctgttgtgcaaagtaagagaacaaa
gagaagtgatgcttttcagaaaaaaagagcaaatatatgtggacaggaaggaacttcgtt
gtccatgtaacagatataaaattgactgtaaaaggcatgtgctcgcaatgtcaaagtctc
tatgagtacagaaggacacagactgtattacctgtgtctaacttgtgctgtttctcttgt
ttctcctggttgacttgttggacagttcgatctaagtctattccttgtagcttagctgct
tgttgtgcaattttctttcaacatctttaagttccatcttaagaatataacaaaatgat
ttcctttaataaacttactgcattattcaaaatctttaaaaattaattgctcttatcatt
tatttttttaaatctaaacttataaaccatttctagatacaattttagcaaagtttaatag
gataaaagtgaaattaattatcagcaattcaaatgatgtaaacaaaaggaagctgactaa
agatgaaaaacaaacagaactgtcttaattttaaatttat >Rad50ex11
ttctttaggactgaactaaattgctggtatcactgctcagaagagtcttgaacttgatgg
agcttatgttgagaaatacagtttatttaaaattttttatctttaattccattttttccat
gaactttctgaagtctccttgtatgtaagaactaaagtttatcaatataacataccatt
catgacaataaattatttttaaaacaattaaacaggtaagcatgaaataagagatttctat
tacatctccaaatgttgcaacttacttcaatttggcaagtctgtccctggtctgattaat
ttcttttgatttactatgtagccagtcttcaagctgtttttttgttgggaaaatatcccaa
cagtgaggttaattcatcactgtgcctagattttattttctgattttgttcatctttgtc
agcctataggtaaaaaaaaatcttttaaaaataaagtctatatctccacattatatcaa
gaacaaaaataaattctagactgactaaagttctaagcttaaaactataaaaatatgaaa
ataaaatataaaatttcttaaagttcttaaagtcttcaagtggggatggtctttctaagc
cttaagagtggagtaccaagtcgaacaatata >Rad50ex9
aaggtctgaagctttaaggtctgagtacagtatctttaaaaagctccctatgtgattcta
attttcaggctatcgggttgtagaaccaaagagtcagaagatcaagatattcagatgaat
tcattttacatgagaataagacaaagttgatgttttttattaaaatgctataatcttagga
tcaaaaatagacaaaatacttctaaaagtattatatcttaaaattattagattattcaaa
caatatcttacagctttttatgagctcctggtccagttcaagaatcctgtctgaagatcct
tccaactgctgtaattcatacttcacattttttcagctcattctgcttcttacttaggatt
tctgattttaactcaattattcttcccagtccagttttcttatctcttatctcatctatc
tgttttttgtttcagagtctcttttttctgcaaagtcattctaaatgcatatgtaaagaatg
agcattaataatttactaaacaatttaagttttttaattgcaaaaggaatatatgtacac
tgaagaaaatacaaaaaagtacagtcgtgtgttgctcagcagggatatattccaagaaat TABLE 5-continued gcatcattaggcaattttatcattgtgtgaacatcagaatgtatttacataagcctacat
ggtatagtttaatacacacatagactatatggtatagcctattgtttatgg >Rad50ex2
aaaaaaacccagaatacaaaattaagagtatgacatcagctatataaaacagtatttaaa
ggaggaggaaaacacatgaaaatgtcaacaacggttactactgggtgctaaaactgtgtg
gggctgactttcatttctctttatagttttccagtgccaagttttctataataagctatt
atcatttttataattataaaaatacaaaattgtactagcaccattaccttgggatcgtgt
acaaatgtatttcctttggttccaggagggaaatctccagtacaaatatattttagacat
tcaatgatggtctaaagaaatagaaaattacattatttcgttataagagaaccacagaag
tttaccataaaatatgaattcattacaaaaatattatttatcatggaaactataaaagat
aaaatctgacattataaaacctgtaataaaaaatgattaagtgttaatgctgtaagttc
acagaaatgctatataactaagaagttatcctaatatgaagaattgttacttgggaaaaa
aataattattttcaactgaaacccttaaac >Rad50pro
ggcgcttcccaaagcttgatcctgggactcctggaatgggggtagtggtggggtggattg
gagacccaggaagcggggtcagttcatgtcaaaactattttccttttcattctcattctc
tctctaacgttcgtgtagtaatttccagtgatcacataacatgtgatgacgccattgcag
tggcggttaatggaatgtgcgcatgtgtattcttgcgcttagaaataccaattttaattt
ctaattgagtaaatgttgataattataactcacgtacacgctctttgaggtcccccgtaa
ttttttagtgtaaaggcgtctttaagaccaaaagtctgggaactaaaactaaaagcagtc
tgcaaatatgaagaatgtagaggtaatccattccgatcagtgctcccagcaatagatatc
tttaaaaataagggaaagagaagttacctgtctcagaagtaactgagaatattgctttct
tggaaacaaacttaatggagggatatcacatttaagggcctagaaaacatacataaaaa
ttactgaaacaatagtggaggacatttaaatgaaacacaaatttggaattactgtagtgg
tataatttgcctctgcctgccttggaaaaatgtaggaaatgtttctccagtcatacaatc
ccaagcaataatttacagaacctaatacataaatgtatgtgccaaaggatgcaagtggg
gaagaccagtgagaaatagtctcttgctgtaccaggttaaaaaaaccggaaagtgtcagt
tattacaaaatagttaaaataactaatggaacaaaacattaaaattatataggaatgtct
tacttggcaaagcaaatgtaataaaacaatgggaaaagacgaaagaccttttttatttt
aaaaattgtaaaatacacataaaatttactgtcttggccaggcgcggtggctcacgcctg
taatcccagcactttgggaggccgagacgggtggatcacgaggtcaggaaatcaagacca
tcctggctaacacggtgaaaccccgtctctactgaaaacacaaaaaattagccgggcatg
gtggcaggcgccgatggtcccagctactcaggaggctgaggcaggagtatggcatgaacc
cggggaggcggagcttgcagtgagccgagaccgcaccactgcactccagcctgggcaacag
agcgagactccgtctcaaaaagaatttactatcttaaccaagtgtacat >Sept2ex1a
ggttcccgccttagctccggccggagcatcaggtggggcccaagacacccgcagactagg
ctgccgcggcctctcccggatccgacgggtctcccgcagcttgtccacactctggttggt
ggtcccagcacatttgcaggctccagcgggtgggacggcttggtggggggagatctctag
ggcgcacgccgtgccccacttcccccttacgggaaaggcttccagcgcgcggacccagg
agactctcacctaggctcggccccaggctccaggggacacgcagaggcccgccgggcacc
agccccgagcccccgacactgccgtcccggtcccccaacgcgcggactacaagtcccag
cagtccccgcagctggcacctcccgcctcgccgcggagaccccccggcgtccaagcggcg
gggctccggctgcgctcgtggccgggccgggcggggaggccggtcccgcgggcgggggca
ggggcggctccgcggcttctcccgccgccgccgccaaggggagtttccaggaagtggcca
tattggatccattcagccgcagccgccgggcgggagcgcgtcccgcagccggctggtccc
tgtcgctgcccctgcgctcgtcccagcccacccgcccggtgcggagctcgccatggcggc
caccgacctggagcgcttctcggtgagggccccgct >Sept2ex1b
ggccgtccaagcggcggggctccggctgcgctcgtggccgggccgggcggggaggccggt
cccgcgggcgggggcagggtcggctccgcggcttctcccgccgccgccgccaaggggagt
ttccaggaagtggccatattggatccattcagccgcagccgccgggcgggagcgcgtccc
gcagccggctggtccctgtcgctgcccctgcgctcgtcccagcccacccgcccggtgcgg
agctcgccatggcggccaccgacctggagcgcttctcggtgagggccccgctgggccacg
gcgcgcgcggggaggcgcggggcgcaggaggggccgccctgcagctggcgggggggcgcgaa
gcgggctgtcagcgcctcacggccgggcctcgacaccgggccagctcgaggaccccggcg
cgggctctcggccgcgctatcgggggggtcccggagcgtcgggcggcctgccttgccgggc
ggctggtcggggtcgcttcctggggcgcaggcaaggctaacccctttcgcgggaaggagc
aaagacccgcctggctccgggcaggtgcgaagatagagtggcgcccgcgggggccgcaggt
gagggtccgggacactccggacccctatcgcccaggtgtttctttctgcacacttgggga
agagtcctagccgcacaggtgctgcgggataggtacagccggggaggatggaggccccag
gatccgagagagtctcccacacgagcccaggacagttgcagactttgagtcctgaagaccc
ttggcctgcttttccttcctccccccgctccctctgccccgctccccacgccggaatcct
gggtgcgactccaggcaggtcaggcctcagtggtcgggtctgcggcagccattcgccagg
agctggagggattccagactcagcccagtgggcgtttatttgggctccagtccaggtcct
cagaaggttgatgtccctggtggtccctgcaggggtctcactgggcctgagcctgccgac
agccaacttactaaaggcttcataattcactcgcgggagggaggcctttgggggttgt
atctggacatcccctgctgtctaaggctggatctgggtgtg >Rad50ex5
actacctatttagtatacaagaaattaactactgtacatcactgtgactttagttaataa
caatatataattgctaagagagtagattttaagtgttctcaccataaaaaaattgaagta
atgaacgttaaatagcttgatttagccagtccacgatgtatacttatatcaaaacatcat
gctgtataccataaagatatacaattttttgtcaattaaaaataaaatcaagttaccttca
atggatcaagttcattctcataggatttgacaatttccttttgaagatgttaactgggctt TABLE 5-continued ccttacttgtaatctgatcacgaatctcacaagcttttccttatattgcttcagatatt
ttagttccatttgatattcttttactttctgaccttgtgtctgacgtacctgccgaagtg
tttctaaggctttaatgtatctttgaagatatgaaacaaaaatcaaatttctggcaaagt
aaattatggtatatattcatacagtgggatattatgctgtcactaagattacagttacaa
tgagttttaataacttgtaaaatgcctatgacataatggtaagtgaaaaaaattacatt
tatactgtcaatcaggtaaataaatatacgca >Rad50ex4
tggatgagaggtagtaactgatgacctttctgctttttaaatttttttctgttaaaaagaa
gcatccaaattgcaaacacagttcaataacttaatggactacaaagtctatttaagggtt
acaaaccttgttgctgaaaaaatctcatcaaacttttgcttcaaagcctttccttcactt
aaaggccaattagaatcttcttgatgacagaaaatgacattatttagcacagccttggaa
accccaagagaactgatcatttctcggtcaatttctgcacacttagagctcagactgacc
ttttcaccatgcctacagaaaatgaaaatcaagaatatatgtaaaataaccttcagtgta
tctattctattgcttaatcaattcatactgtacttctttaaaagaataaaaaaaaaggcc
cttcacctatcccgttagaaatggcttcatcatgctaaaaagtgtaactcttaaactatt
taacggttcacagatgaaaagatatgtaaa >Rad50ex25c
gaccccattcaactacttcaaattttagttggggaaaccaagtcccagagagagaggtca
ctggatttataaagttaaaagcagagccaaacatacatctcaccatttctggtcatcctc
agatattaatactcagtttttcaaccacatgcaaggaagtaaattcagaggtaacattt
aactatgatttaaaaaaataccaaaaccataaattttcaaggcagtaattatctccttct
caacagtgctttgagaagaagcatgcatttgcactggggagggaggcacagagtcgagtc
tcggctgtactgctgaaccctgaaggcctgacagaggctgcctggaatgggatgaagagc
agcaaatcagaaacaggcaatctgtccaattttcagtgaaacaagtttcatgattttaga
acctctcaacatccaaaatcctagacacaatgttcctttgaaagaatatatttcttatt
gactaagttgatatgagaaataagtttcttattatacactttctgaggacctacatttct
atggcatttaaatcttggatatttttaatgaacattgaatcccagggagctaacactgca
tttcacaatctctgagcactgatcgatgttcttttaatcctgtagaatttctccacata
ttcagaacgtcctaaaagctccacaaaatcttcatcatgagtgattaccagaagctggaa
gttacgctgctgtgagcgacttttatttatctgcaacaatatattcagaacatattatta
gtaaagagcataaccccttctttgattgaaaagtcaccgcaaaccttgtcagacacatg
aactc >Rad50ex1
acacctgtggagccctagggacgcttctgctcctaaggagagttctcaacttcccattttt
attctccgaaagatgtagcgacctgtaaactgaaggcggctactgaagacttaccgtctt
tcccgcccattgggtccaaccaaaattgtaagggggctgaagaaagtgataaatttgctt
atctttgtcctctattccaaaactccgcacgcccagaatgctcatcttttcgatccggga
catgtttgcaaacgtttctaatctcaccagggacctggagtccacaaaagcttaactgag
gccgaagcaaggcgtgcacgggacgtgagacccgcgaatctcagggtcaggaggatccgg
gcggggagcgaggccacaggactgccaaaagatcctgccagccaacagcgggagagaggg
ggcggggatggagcctttcctcccacaccagctgctttccccgccggtggggagagcgg
aggcggggaccagcctgggcgtgcccgccggggacgcaaagccgtagccacaatgcgacc
ccgcaaccgcgcactcacagcttcctgcctcggccgccctgcggatcacgtgggcctcta
ggcccgcacgcgtccacgcgcgctctcctggggcacgccgggaaatcagagtcccgcggtg
cgtgcgcagctccgacttccgggtgcggtacggcgaagcagagggctaggtgctgggtgc
tgttgccaggggcagcggacttccggatctttgctgggggatgggcagcctggagaggcac
tgacttttg >Rad50ex3
aagtctattgaaaaaaatttaatatgctcccctaaacttatagtagaaaacaaccatcaa
cttacagacctaaaagactgaaaatgaacagaaattcaaatatcatataaacacctactt
tgttctagtaatgactccttccagagttttaaattctgtcttttttgcttttctgagtaca
caccatagatctttgcacagctataagttctccattgacatcacgaaattgcagacgaat
ctgggctctcacatctgtttcttgagcaacctttgaaggaaaacacagaaaaaacttatg
ttactttaataagcaccagtgttggttctgagaaaaaggcataagcaatcttacccaaaa
tgagggaacaaaaagaaaaacatccaaaatgagtgatattttttacatgctatccaaaata
tagaagaatactgtttaattaatttacaaaaatgatatactatcta >Rad50ex8
agattttatcctaacactaatagaaaaatatgccaaaatggagtccaaccaaaaattaaa
acaattcaagtagagaatatgatgcaaacaaaataacaaatactgtatttcaaaatactt
gccatcagttggttggcagttttttgcttcccttcttgtctctctctcacaagtttgtga
aaatttttaatctgtctttcactgaatggtccacgctcaaagccatccaattctagctgt
gttgccaaagactgaattaatgaatctctagctcggatatgttcttgatggcgatctgct
tgcagctgtagacgaccttttaaaaaaaaaaatctcataatttttttttcaactggtgctt
aaaaagttgagatagctgcagattcacgagttataaaaaataatgcagtgtgtctcttgt
acattttgcccagtttctcccaatgataacattttgcaaaactgcagtaaaata >Rad50ex7
tgtatagccttttaagattggcttttcactcagcataagtccttggagattcttcattca
tacagaaaatgtataacatcatagtaggaaaaacgaccaaataaacattttgtcctaccc
tgttcaacaagcagttctgattttcctgattgagaagcctagattctttatttagttttt
tccagttcacgatgacagtctaccaatttcctttctttctcccttacttgttctctgggat
tgtgatataagtcatttagttgctcatcagtcccttgaaaaacctgtgtaacaccaaaat TABLE 5-continued aaaaagctttaatgtacaaacataagaaaatatgatcactttgaggtatcaaatataaac
caaaccttattcaatatccttcattttaacatatacatagaagtaacaagatctgtattt
gttttttttccaatgtggatggcaaaatggattcaaataaagttcatt \>Rad50ex6
atacatagaagtaacaagatctgtatttgttttttttccaatgtggatggcaaaatggatt
caaataaagttcattacaataatcccaaaattttgaagcagaacaaaattctaccaccac
aaaccttttccattttctcttccagttcactattatctttctccatttgcttcttttcggc
tatccaaggctttaatttcattgtcaagtttcattatttttagagagattatgttcaattt
cttttagacgattctgaaaataaagaaacattacataaataaaactcactatagcttaca
tggctgatagatgaagacaagtaagatactccaggtccaggatttagtaaaagtgatctc
atttaaggctaacaataacactgtagagcaggcctagagaaactgaagttcagagacatt
aagtaacttggcccaagtcctcacagctagtagagagaagcaggaat \>Rad50ex10
gctcacttagcctctaaaatatagtcaataccaacttaatacccttatagtctatgactta
tgagtgcaaggtaggctatttttaagtaccagacagtataattagaacaaaaagaaaaatc
atactttgtctttggtcagcatctccatttgggtacgtgttgttgtatgatggtttaact
gctccatctcctggtcaagtttacgcagggtcctgtctaagtctgctttttcattttgga
gacttattacttccattttttaaggtttctacattgctgttttttctcagccttgcttaact
cacgttcctagtcaataattcatacaaatgcaaaggtgttatatattttgtgcaagaatt
aaaataatgacaaagtgtattagaaattaactact \>Rad50ex12
tgaaatccaagccattaggctccataaccaggttttttaaattccccatccttaacagtta
cctgtgaatgaaaattcaaaggtgtcaaagtatcctgataatataaagtagacaacttac
ctcgctgttttgatgatttttcaatttcctcttaagcctgtctaaatcactttcaaaat
cctggctaccacaaacatcaaacagcttgtcttcgtaactggacaactgctcttcctttc
ttttttagttcattatttatatgattttttattctgctcagatgaagctagttccttgctaa
aataagagcaaatatggattttcattttaaaataggagaaattagtttgaaaatttgagt
aggcaaaaacaagacaaattctgccaacaaatcat \>Rad50ex14
ggggaattctaaacacaacctgtacctgaatactagctactattttttaactctcacactt
caaattcaagccaccatggaacaagttttattctgccttaaaactacaataaacttacctg
gaacctctccataattgtaacatctgtcaggcatactttggcactttcttcttcaggcat
tattgtacccaagagtgtttcttgttcttctatgtcgttcttttaggcctgtatgtctcta
ttgacattctgcagtttgtttcttaattctggtatttccttctccttcaaatcaattatg
ctttgcctaaatagaaaacacaattaaaaataaagtatctgatgtttctcacagttagac
tgaggttatgtattttaggaagaataccacagaagtgacattgtgttcttttcagggta
tcatatcagtggatatggaatcatgatatcaatatgtctta \>Rad50ex13
cttatcatagaagtgatataagacagggcataccagctcagagtccttactgagtaacta
ccatctgcccaggcatgagatgggtaccttttacaatgtgctgctacatgtacagtgaag
gtaaatcccattcttacctcatgggcacaagtcccagcatttcatcacgccgctttttcct
ttttttttagctctgattctgttgacttgagtttatctggagcaagtcgcagtttagact
gcaaatcactgatgacttcttgtaactcagcctctgtctgaaaaactctctgacaaacgg
ggcaacatgactggttttcgtctgttagctgagtaatgaactgggagtaaactgctgtgg
ctccagccagcatggctattttaagaaaataaattatatcaccaatgagaaaaaaacata
aaatacagtattctgaatacggttgtatctttttctataaatatatg \>Rad50ex17
tatgatcgcagacaagtcccttctcacctataggaattgattaattagtctcatttctt
aacttctattgtagatcaagcagcaaaataatttacatcaaatccttgttctaacaagaa
tttctaatgtcaaaattataccatgaatctgaaaatactatttatcttatgctatttaat
ttcatgtgaaataagtgtccgacgtggtgctatgaacataagtttaatacagatatttga
taagtaaatatataaatgaaatcttacttttatcctgtgctattttgttgcttgtatttt
tttgttgattaattcttcttttttcttgctggaacttttccaatgttgtttccaaagggct
tacctgctctttagcatcctaaaaatataaaaagataaagtattatataataatattccatt
atcttactttagggggtcagacttcacagtcttaataaaagcactttctatgtgccaggct
ctaaaagtcaactcatttgctcctttcaatgaccctatgaggacagtaccatcattttca
gtcctata \>Rad50ex16
gtaggcggatcaccttagttcaggagtttgaaaccagcttgtccaatggcgaaaacccgt
ctctactaaaagaacaaaaattagccaggcatggtggtgcacgcctgtaatcccagctac
tccagaggctgaggcaagagaatcacttgaacccaggagatggaggttgcagtgagccga
gatcgtgctactgcactccagcctgggtgacagaacgagactgtctcaaaaaataaaaat
aaaaataaaataattaaaataattttacaaaaaacatgtatggatattcttaccttttatct
ctctgtacaaagactgaacttcagtggataattccacagtctgctcctccagttgctgac
gacgttgcaaattagtggatatctgaagtttctcagattttagctcatttgttgtacttt
ttagatgttgaatctgttcctgctggtcctgtataagcttacgattcaattcaatcttac
tagaaactacacaaaaacatattatcacagtaattaatgtaagggcatagaaaatactat
ttgtatcattcttcccattttttatcggtctatggaatccacaaatgctatttctgtgggc
cccacccactgcaacaaaaatacaat \>Rad50ex23
gcaaagagcttcccaccattcaggtgtagccttgggtgcttccactgcactgatgtttgt TABLE 5-continued ttctctctttcagttacttgggtgagttggctccccaggcttttgagatacctgcctttt
gtccagcactgcatcgtcctcgcatatccaaggctgtgtctcccttcagcatcaccactc
ggtagttataattccgcctttatcagaagctgatacattttcatcggcatcagaccgta
tttctatgtattcaatatctgacacaggaagaagaatattttagaggaacctatgctctg
tagccttttgtcatttacaaacatatcaagtaagcctaggaacaacagatgaggctgaca
ttaccagaggaaaacaatggctggtgtg >Rad50ex22
tgccaagataagaattcttagaaaatctcaaagacatgcttagaaaggggtccagggagg
taatgctggcatgatgagaggtcataaggggaagagctgcggagagggctttggaaagag
catttgtgatacaccatggtactcaccttgtccacgataggtacttcgccacaggtcacg
tataattttattgatttcttccattttcatactgtgaaatttcattattgctctggaaaa
ggaagtcattggtacttcatatatataaaaaataattatgtgtaatagtaatattaaaat
acataaaatatataatatataaaaaatagaaatataaataacttcctcaatattttcaat
ggtaaaagtagaatatagtaagagctacaaaaataaacagcagcaaaactttgctgcttg
gctaatactgaaaattggcaggcttatttctagtgctccaggggtacccttc >Rad50ex21
gatgactaaagtatgttagttaatattaactgcaataagaaaatccccagtctaatactt
actggtcaagagtcttataataaatatccagatccttgttcacaagttctgttgtcctca
taacaatcatcatttctctatacttttcctcagcatcccgaaatgtggttctcgaagtt
ctttcttaaaatgaataatttcttcttcataacctttctgtcgccctaatgccaaattat
gatttctttttatattgtctatgttctcttccaacttctgatgttcactgtaaaaagaa
aaatgacaaatgaggaccatttttagcttttaacaacctgaagtggaaaagtcatagat
ttctttagataggttaagtatcattctccttagcaatcagtatattataacagagtctct
ccttgctt >Rad50ex20
acactgttcaccttctagtaactctcaaaggataccaggctgaggctaaaattcttttaa
aacaggtatttaatattcttcacattccagtaataaagacgtttatttaaactgaagatt
attttaaaagcataccttttcatttgcaaaacctgcatttgacccatttccttcaaatgt
tgttttctttcttcttcaacttcttttagttcctcatttcttttttcttaaagtaaggtta
tcttgtagccacctttcttgtatctaaaggtaaacattaaattagttaacaaaaataacc
aagttactaacatgaaatcgtaacaggcaactggtgacagcaagtgccatttctgtctt
acttagaatcatgtgaaattcaacagagggagaat >Rad50ex 19_18
gtgtgagccaccacgcttggcctctttccttttttgcatttctattcaatggatcttctat
tgaaaataaaactatagaaagaatgtcataggtgtaagtgatatcataagcaaaacaga
cctaccttctgtgtatcaatatcttgtctcatgagtctcatatcttcatttatcttttct
ttgtgtttctcgcattcacttagttgagctattacttttattaagttcagtttcttttgc
tacaaaaagaaaattcttttaagcacatgaataaaaatacaatcaaataaataattttaa
gttttaaattaccttcttatagtcgtctttcccatcttgaatataattctcaatgtcttt
catatagccatgaatatttttaaccttctctttaatatcattcagctgtagaaaaatatt
cattaaatttacactggttgtacttaagggcacataacaggagagcacagtaaaacactg
gctgggaagttatgaacattgggttccagtttccaccactactgaattttatgatcgcag
acaagtcccttctcacctataggaattgattaattagtctcatttcttaacttctattg
taga >Rad50ex24
tatcacaacctgtccccaaatgtgagatacttactcaaccagagcatgtgcaagagatac
ttactcaaccagagcatgtgcaagagattcaatgttttctcggtcaagatttgttgttgg
ctcatccaaggcaatgatgccacagttgaggcagaacgtttcagccagggccaggcgaat
gatgagtgaggctaatacctggaaaaaagcccctatgtgagaagcccagcacagaccttc
tcatctcatggcaggcaagcagtcctgacatgatcttttcagcagggaaaagtgggaaac
gtcacaggttcactgttaggtaaagcactgccctctgggagagcccagcactgggaccag
attcttagttcctcca >Rad50ex25a
agataacattaagaaaatattatttgcaaaactgtgagtttgctaaagctaggagatgtt
gaattttatcaaatatagctgctagaattttttcagaattttttcaccttcggttttat
tatagtgatggatttatcaacagattttcatttctgaaatcttgcattcttgggtataa
aaatatcttggttattgtggatgtttaatatatgactagaattgatttgctcttaatcttt
actcgtgattacatttaggaccccccccaccccaccaccaccccaggatactctgtct
taaggtccttagctttaatcacatctgcaaagtttcctttgctgtataaagtaacagtca
cgggttctagaaatcaggacctgtctatctttgggggccaaccattttaacctagcacaga
tagatgccttaggaccttagggcttaattctcttctggacccagttgagaaaagctgtct
aggcaaacatgctcattatagctacagatggcacaaaaccatgccatgtgactgaatcaa
gacccggtatggtcctggctgactctgaatgacaaaactctacaaagcataattcaaaag
cgtgtgacttggttgcattctgtgtggaatggaaggattcaagatgtcagctggcaa >Rad50ex25b
acaaagcataattcaaaagcgtgtgacttggttgcattctgtgtggaatggaaggattca
agatgtcagctggcaattccaggaaaaactgtgattaggcttttcttagaagtggcatct
gaagagcaaatggagaggcctgttcttccaggtctggttgaccctacagggagcaggcc
ttgactctgtgagtgagcctggcttgccttccacatggcaatgcccacttagagaggaat
caggattgatggtgaagccagtatgctacacaggatagacgcagaggagtgttacaggct
tcttcacgatgggcagatcaggcctcaagtggtcagagctttccaaaggtgggtgtgcac
agtggagaatttcctctctgtagagagagctctgagtctggatgaccatctggaagggat TABLE 5-continued atgtaggagaagaaggtggtgggtactgacttagatgattacttaaggttcctgtcaaac
tttgagacccccattcaactacttcaaattttagttggggaaaccaagtcccagagagaga
ggtcactggattt >Sept2ex10f
gtgtttggaattttgtcttctttagctgagaccaaattaaaccttggtgcataaagtgag
cttaaaacttgccactgtttagtaagttagccccatagaatgtgaccctgtctgcagag
tctcatttaccccctcttttctcattgtcatttgttggctttattagggctgtcttacag
gatcatgttggcatttactatcatgtctttatcataaaccatgtttgtttgaggtagaag
aatcaccatataattcgttgcccaaattgggactattgagagagaaggggatgctatta
attacaccagatcaaaaggcataaaccagacctgtcccaggccgatgtgaaatatgttc
tttctagttgtgggtaccctgatctaggtggtttgtaattgtgcattactgactgcatat
gtttgtgtatgtgtaaatgtgggctccctgttaagtgggctcatggatacgaggcctga
ggaagtgtggcttgctagtctgttacgttaacatgcttttctaaaattgcttcacgtgtt
aattcatttactcctgcattcattgactgttttgttcttttccattcactttgtactta
ttttttcattaaattttgcatttattttgagtttttgtggtgtcttttttgggcagtag
cttttctgatttaacgtttcctgagcccattaatc >Sept2ex10c
ccagcgttttactgtgaatgtaaatggaacagcagcccaaagctgttgtctgtgcccca
gaggtgctacctgtagacagggaccaactccatgtgtgtgttaagtgtttgactccaa
ttaagactcccaagcaaatcctgcatattccaaatgtaaagagtactcagtgggaaaaag
gttgttacctcaaagtcattgcttcttcctggctgggtcacaggggtgaagagatgaagg
tgtctgatgtatatagacaattagggaaaaatgagcggcaaaggagctttcccccttcagc
tgcactctaaagggggaacattttaaggaagtactagcagcttgactcttctatgctcct
gttggtttacaagccaccaagaatgtcagtgttgagaatacggcctggtaaaatgggaga
tgtaaaatgactaaatgaaaggaagggtagtttaatgtttgaagcaccgtgctgggcac
tggagctacccagaggaatgcacaacgctcccctcaaggagctcacagtctagcctactc
cctggctggaagcctcaggaagacgtgctaatttattgtggaattggtagtttgcttttc
atgccctgtgttccttctcatgaccatt >Sept2ex10d
caacgctcccctcaaggagctcacagtctagcctactccctggctggaagcctcaggaag
acgtgctaatttattgtggaattggtagtttgcttttcatgcccctgtcttccttctcat
gaccatttccccctttctgtctggcttgcattattgatttccaggaccaagtcctggctt
cctcctgccttcctgagatgatgttctgctcaggagaagtggaggggtgagctgtgtgt
gtccaccgaggcacggccaggaagaggcagccttacctgtgagggctccatgctccag
cagcagagcaggttctagtgacaattcaactttttatgctatgaccaggggtggatctaa
attttatggggctgaaagcttgaattatttagaaagacttctttaagaaaaacaatgtta
atataaaattaggtacagggtcttggaaggggccctgaagattaagcttccttagcgtca
caataagtccgtatctggttgcaattgaaaactgatgcttcagtgagggtatctaaaaag
gtaaactggcat >Sept2ex10e
cgtatctggttgcaattgaaaactgatgcttcagtgagggtatctaaaaaggtaaactgg
catatccagggcaaatgtgggctgccaatggctcatctctagggtaattttatgtctgaa
agtgtatgcagttgggtcagagcatgacctttaagatagcctctctcagctaacatattt
atgaagatgaggcctggtgacccagcaggttcattggatacataagaaatgagaattcct
ggttcatgggccaacctaggactctggagtatgcagacttggccattcgtccattgtggc
ctgcgggtcgcaccccaggcatactgaaaggccatactcgtggctggctgcctgcgggcc
taagccttcccaggatcttcaggacacttgacagacttgtgttttctggtctgagctgcc
tccacaggtcctccagcaagcctcactgcacctctccctgctgtttgtgtttggaatt
ttgtcttctttagctgagaccaaattaaaccttggtgcataaagtgagcttaaa >Sept2ex10a
cttgctgtcttttgcttctgtttgatttggtctgcatatcttttaatgtgtctgttttgt
tttgtttgttttattttatttttcagttaacgcacgcacagacttacatgtcaagagtg
gactttagactttcatgtgttaagttgcttgagttacaccttgtgacccttctcccataa
catggtgtgaggacggactgggagccggtacagactccagtgtttacagccttgctttcc
tcccaccgaccctggccccaggctgccccgggcctggcgggccaccccctctctatgcaaa
cacgtaaaagccatgaatgctggaatccaaaactgacgaggtttattttttcagagcca
gtggctggtcttccatttacagtgtcactattccctgacggagctgttatgtgccgctct
agcgaaggcccccagccgggatgctaggcctaattgttcagcgtggagatggcaactcacg
tggtgccctaggtgcagctgcgtggtctggtatacatgctgca >Sept2ex10b
ttcagcgtggagatggcaactcacgtggtgccctaggtgcagctgcgtggtctggtatac
atgctgcaaaattcacccagttcccctcattttaattttctaacctacagcttaatttt
aataactttaaaacacttctaaatatttattttggcaccagcgtcaagacaaataatatc
ctctcccattattttcataagtaacacagattccctgattttaaaaactaaaaatacag
ctaaacctttcttatgtataaagtatgcctatcatatacagggagaggtgggtaataaac
ttcctgtaatgacagtgtttggcatttctttatggatggaattggaacatgaacaagacc
atgtccagcgttttactgtgaatgtaaatggaacagcagcccaaagctgttgtctgtgc
cccagaggtgctacctgtagacagggaccaactccatgtgtgtgttaagtgtttgact
ccaattaagactcccaagcaaatcctgcatattccaaatgtaaagagtactc >Sept2ex8
ccacatgattctacttctctggctctccctgccctatcccattccgtcataatcccatcc
ttggcctcttttctctgggtctccacagcctacaagagacatacgaggccaagaggaagg TABLE 5-continued agttcctaagtgagctgcagaggaaggaggaagagatgaggcagatgtttgtcaacaaag
tgaaggagacagagctggagctgaaggagaaggaaagggaggtatgtgccaggctggggg
ctgggatggggaagctgagggagggaaggcctggctgagggtagaggtgggggtgccttc
ctggcccaggctcaag >Sept2ex9
ggggctgggatggggaagctgagggagggaaggcctggctgagggtagaggtgggggtgc
cttcctggcccaggctcaagccctcctcttgctccccgcatcttctgccccctttctgat
gccagctccatgagaagtttgagcacctgaagcgggtccaccaggaggagaagcgcaagg
tggaggaaaagcgccgggaactggaggaggagaccaacgccttcaatcgccggaaggctg
cggtggaggccctgcagtcgcaggccttgcacgccacctcgcagcagcccctgaggaagg
acaaggacaagaagaagtaggtggcaggctgcgcctgcgctggctcctcttgctcctgtg
ggctcttgctttcgttcttgtccctcacctcccttctcgctctcctgctcgccctctctt
acccctttcctgttggttttccctcatcttcagtggctctcccccagctt >Sept2ex7
ctgccctgctgcctgtagtaccctgtgctgtttcctcctcatgcccacctgcgtgcctac
cctgactctggagtgtgcccgcctgcatgcctgcctgataccccaccggccctctgcttt
cagtggagaatgagaatcactgcgacttcgtgaagctgcgggagatgttgatccgggtga
acatggaagacctccgcgagcagacccacagccggcactacgagtctaccggcgctgca
agttggaggagatgggctttcaggacagcgatggtgacagccagcccttcaggtgacagc
ctgagccagagtgagcctgtcttcacagctgtggccagacacaccaccctggcatctgtt
ccctgagggaccccacatcctcttacccctcgtgcc >Sept2pro
ggaggcatagttaagtaacttgcctagctaaggttaaaaagctagcaggattccaccagg
aaggtttgccatagatccagctaccctaaccactgctctgctctatttcttgtagataac
tttaatacagcatgggaaacagcaacatagagagaggagcaaagtgaaaacattgtcagg
aaggtccagcgggaagtcagtccaccttggggacaagctacagtttgcctgggagagtga
ggagggaaagccaaatcagggtgacaaggtcaaacagcagagaggggggctcctcttaag
ccaggtgtgctaagtcgaacgtggtctttaggcacctccagtcagcacaagtttctgagt
aggagaaacaggtcaggttgcttctcagcatactgggtgaggggtgtgtgtggagggtg
gaccaacctgggatgaggccagtgggggtagggggcaaaccttgccacattcccagaaa
gagcagagagaaaggcagagggaagagaaagaaacgggtttcagaggatttgggagctg
cttttgtatagattgtcagtgagaaggatacagaacctcctgaggcctccgaccctggcg
taagtgttaattttctgaacgttttgagcagtgacattagcggagagaacgtgcacgcac
tgggagtggtcatcctctttgcacaatggtggaaccattaagacgttgtcccaagccctt
gggacaggcagggtgatggacacttgcaatctgacgccttgaccgtcgagctccgctttt
ctattgcaggaatcccagcctaaactgcgcatcctgctcgttggttgcacaaggagccga
aggctggtcccttgcccgggaaggccgcctggccggacgcgcgggtcccgccggggttcc
cgccttagctccggccggagcatcaggtggggcccaagacacccgcagactaggctgccg
cggcctctcccggatccgacgggtctcccgcagcttgtccacactctggttggtggtccc
agcacatttgcaggctccagcgggtggagacggcttggtgggggagatctctagggcgca
cgccgtgccccacttcccccttacgggaaaggctttccagcgcgcggacccaggagactc
tcacctaggctcggccccaggctcagggacacgcagaggcccgccgggcaccagcccg
agccccccgacactgcc >Sept2ex2
ggggcatcgggctccctctggggaaacttggcctggagttggtgctcgggtgtactcagg
gtgtgtctgagatttgttgagaattcagacatcgggtggggctgcttcactgtttttaact
cagatttagcgcccacccccgcagcttgaccttcttccccagtgggctcatgtcttgctt
tatttctctcttggcagaatgcagagccagagccccggagcctctccctgggcggccatg
tgggttcgacagcctccccgaccagctggtcagcaagtcggtcactcagggcttcagct
tcaacatcctctgtgtgggtgagtgtcagggcctggcctcagacagagggtgggtgagaa
cctcctgggagaggggtgcttctggcccctgttgagctgcaaggggcttcccaggca
ga >Sept2ex3
agttcctggggaatgggggtgatgagggatggggtgggcggcctgccccttttctcttatc
caggggccatggatgcctgagccctgcctggcctagccaccagtcaaggacagcccattt
ccagcctatgacacccacttcttcccctcctgtcctcactgcccaggggacaacggcatt
ggcaaatccacactgatgaacacactcttcaacacgaccttcgagactgaggaagccagt
caccatgaggcatgcgtgcgcctgcggccccagacctatgacctccaggagagcaacgtg
cagctcaagctgaccattgtggatgccgtgggctttggggatcagatcaataaggatgag
aggcaagaggcgggaagggcggcccccacccagcctcctcccaccccacctacattggccc
ctataacagtagcccagccctcacactgcaggggccagggagggcctcttgggaatat
ctgaggctctgtggtcaccaacagacca >Sept2ex4
atctcaggcagaagctgttcccagaaagaaaaggccaggggcagcctggcttggccccg
agccctgagcccccaagccccaagcccctgatctcagctggcagcctcctgggtgatgg
agctgtctgtagttacaggcccatagttgactacatcgatgcgcagtttgaaaattatct
gcaggaggagctgaagatccgccgctcgctcttcgactaccatgacacaaggatccacgt
ttgcctctacttcatcacgcccacagggcactccctgaagtctctagatctagtgaccat
gaagaaactagacagcaaggtatccctgtccccacctgctgtcacaggctccatagtctt
ctgctgcgatgcgatgtggtggctgcctcatgcctgaacaccatggtcctcagggacctg
gtcgggggcttgtgggtggcccccccattggc TABLE 5-continued >Sept2ex5
tctctctggcctccttcccctgcccagggatatggcctgggcatgtctatccatatcct
gggcatggcatgggaaccaccgctcaaaagagccaaccagcctgctgtccctccctga
tcctggcaggtgaacattattcccatcatcgccaaggctgacaccatctccaagagcgag
ctccacaagttcaagatcaagatcatgggcgagttggtcagcaatggggtccagatctac
cagttccccacggatgatgaggctgttgcagagattaacgcagtcatgaatgtgagcgtt
gggtgagggcctcagggccctgggccagagggcgaggagccggcacagatctgacacag
ccccaggagactcttgttccccaggattccagccttagcttctccaggacagaagggtgg
gcatctggagctggccagtcctacatctgtgggcagggggacaggaaga >Sept2ex6
ggagttctgggacattctctccagaagagagccaggaagtaagcatctggccctggagcct
tgttcaggtctggctgcccctccctaggacccaggggcagggagggagagtctgccatt
agtctgtgtcagctcagggcttacgcatacccgggccccttccaggcacatctgccctt
tgccgtggtgggcagcaccgaggaggtgaaggtggggaacaagctggtccgagcacggca
gtaccctgggagtggtgcagggtgagtgtggacaggaaatgcatcctgggggtagaac
tgagttccctggcctgccctgctgcctgtagtacccgtgctgttttcctcctcatgccca
cctgcgtgcctaccctgactctggagtgtgcccgcctgc >IGR3000a
cgaggtaaacaaagtagggggcaatgatgctgcccactctggaggccgtggatgtgaccc
ccaccgccatgttcctgaccagggttgggtagagctcagcagtgaagacatacagcatgg
agaaagcagaggtgatcccaaattttcccagcatgaccagaccaatggataagaagtaat
aatctgaaaagagacccggtataaacaatggtgcttttagaaatgatactttcttatat
cagttattttttattgtcctttttgcttcagtgggagtacttttattaacataaatatatt
cccaaaatagcattttctcttcaaatgtcctaatatttgggcatggacaaagatggagct
catgtgagggtggctttgtactttgttctactgttattctaggtcattaatgcattcag
tgaccttttgtccacttgtcttttgtttgttaaaacagtttcatgggtaagctattagcat
gttaatatagttaagttttatcttcaaagaggaggaccaatccttttctatcctctttttctt
attattaagaaatatgtatttctattactatcaataatttagtgacattttaatattatg
agaacgtcagacacaaggggaaaagggaagcatatatcctttttgtgtgctatttaactac
ttaaagattcagaccagaaaaccactgaatgtatcctgga >IGR3001a
tcttcaaagaggaggaccaatccttctatcctctttcttattattaagaaatatgtatt
tctattactatcaataatttagtgacattttaatattatgagaacgtcagacacaaggg
aaaagggaagcatatatccttttgtgtgctatttaactacttaaagattcagaccagaaa
accactgaatgtatcctggaaccgacatgtcctactcactgtaatacttgaatatacacc
cagggaaaatgtttgagagtagccagaaattaggaatcatgactatgagttaaagggaga
tgttaggtgagtctttctgtgaagggatgactgggagagttactcttcctcttttggtgc
tttctgcttctctgagactgtctcttctgtttggggtagttgttttgaacacaggaaaca
acatacgtagtgagcaatcacctgtctaattgacttatgaatggcttatgatgtaaaggc
tgaataaacatggagcagtgactcagaagcagcctagtcaatatgtgggtcttttctggt
aagctgttcatcttggttaacttnntacccacaggtaccagttgaatgaagagaagcaca
cctcctccccagaacagtactgcagctatgatataacgcctgggcagggttcgcaatagc
agccaggctgtaatgtaagctggaatttcaatcaaggcag >IGR3002a
actcagaagcagcctagtcaatatgtgggtcttttctggtaagctgttcatcttggttaa
cttnntacccacaggtaccagttgaatgaagagaagcacacctcctccccagaacagtac
tgcagctatgatataacgcctgggcagggttcgcaatagcagccaggctgtaatgtaagc
tggaatttcaatcaaggcagagaggaaacagttcaggtaggcatctccatgtaaattagg
agcatccagagacagagcaaagtaacccactgaggtcagcatcctgaaagaagaaggtaa
aaatgacaaagggatggtgtgaatcgccctaaaattttatgatggtcaagaaattctcta
tatcttgctgtcttatnnatagccactaccctcattggctacttaaatttgaataaatta
aaattaaataagattacaaattcagttccttagttacactagccacacttcaagtgctca
atagccacgtgtanttagtggctactatattgaacaacatagatatgaaacatttccgtc
actgcagaaagttctatnggacagtgctagtctagatataccaatattcaacaataactt
ttctcagctagttgatttcaagttttcctatttcctgaatagtttgtacctcctcaatct
cttagagctattatatgaagaaaaaatattagtcacatca >IGR3003a
gctactatattgaacaacatagatatgaaacatttccgtcactgcagaaagttctatngg
acagtgctagtctagatataccaatattcaacaataacttttctcagctagttgatttca
agttttcctatttcctgaatagtttgtacctcctcaatctcttagagctattatatgaag
aaaaaatattagtcacatcagtgaacataaaatccagatttcattctttaacaaaaaaga
gatacaagggtcatactgtgggattcacttagaataaattctgattnnnttttagggaaaa
gagtgaatgtccccctaatccttcaaagtatnacagnctgcagtntgtatattnngtcatt
atagttaacttccatgtagaagcttctctgtgggccatgcgtggtgnctcatgcctgaaa
tcccagcactttgggaccgaggcaggcaaatcacctgaggtcagcatcctggagaccag
cctggccaacatggtgaaaccccgtctctacttaaaagacaaaaattagccaggcatggt
ggtggcatgtgcctataatcccagctacttgggaggctgagacaggagaattgcttgaac
ccaggaggcgaaggttcagtgagctgagatcgcaccattgcactccaggctgggtgaca
gagcgaaactctatctcaaaaaaataaaaacataaataaa >IGR3004a
cccgtctctacttaaaagacaaaaattagccaggcatggtggtggcatgtgcctataatc
ccagctacttgggaggctgagacaggagaattgcttgaacccaggaggcgaaggttgcag TABLE 5-continued tgagctgagatcgcaccattgcactccaggctgggtgacagagcgaaactctatctcaaa
aaaataaaaacataaataaaaaaaagaagcttctctgtggaaaaataactatgtaactga
gtaccccattttttctaagagatagtttattttctctctctcttcttttctcttttcctcc
ttttctgcacttttctacttagctctttagaagtgcaattatagccttttaacctcctctt
cactggacactccctgcagggcaaattcatctaactatgtgcttagaagctccagagtgg
aactctcaccgcccagatttcctcaagcgatatcagtcaatttccaactcaaagtatgcc
tgctagagtttttggccacctatacaacctgtttctgcccatgaaggcaccacntcaact
gcccagtagataaggcagcaagctagccntctgatccctcacctgctcgcgtcctcccct
gccttttagaagtgcctgctttccgcttcaaaaagaggagcggtggtaccttcaggcag
gaagccgatacctttctccctaagctagctttggaataaa >IGR3005a
tatacaacctgtttctgcccatgaaggcaccacntcaactgcccagtagataaggcagca
agctagccntctgatccctcacctgctcgcgtcctcccctgccttttagaagtgcctgct
ttccgcttcaaaaagaggagcggtggtaccttcaggcaggaagccgatacctttctccc
taagctagctttggaataaaaagtcacttttccttacatcagactttgtcttgttaattg
gacgctgcaagctgtgagtgactgaacctgagttttttgttacaactgcactatgcagaca
ccctgtgtagaaatttgcttattattaacatgactgagaagcagaggatatctgaaaaa
tgacttcaggaacactagtggatcttttacacatactagacccaaattagataatacaa
ggactaattcataaacacaacaaataagtatgctcaagggatcttagtgattttcccatt
tagtaataggagtagtttagatagaactagtgactaattttttattagcttagtagcacc
actacccaagaacatttgcatcagggatataggctgaaatgtaagaactaagaagcccat
gtacctaggacacacttgcttaattcagacgcataagctctgtcattgatctcttctaat
tgccaagtaggatggccctaaaaataaacttagattagc >IGR3006a
atagaactagtgactaattttttattagcttagtagcaccactacccaagaacatttgca
tcagggatataggctgaaatgtaagaactaagaagcccatgtacctaggacacacttgct
taattcagacgcataagctctgtcattgatctcttctaattgccaagtaggatggcccctt
aaaaataaacttagattagctgcagcctaaatctaccagttctgacgatcatcgtgtgtg
tgtgtgtgtgtgtgtgtgtgtgtgctgccatcatagagtaggaattttctttt
tccttttttcttggcagataaattattaaatctaatctataaagccaattcagtatttct
gcgcctgaaagccacttgttagtttgctattggcacgtgtaaaaagctgatcaaggctcc
aatccaggcaatgggatctaggttattctagcctcagtgttcaattgccaggtcagctt
caggaagcaggagctgaattagcatntctgcctcaggcaacacggacatcattagtctta
atctcataatttttggtggggagggaaccattacccagggacatcaatgatctcaatccc
ataactttaggagggggaagggaatgctttcccttttgggtcccagtactgcagacttaaa
tactgtaccctgtgactttttttttttagatggagtctt >IGR3007a
agcatntctgcctcaggcaacacggacatcattagtcttaatctcataatttttggtggg
gagggaaccattacccagggacatcaatgatctcaatcccataactttaggaggggggaag
ggaatgctttcccttttgggtcccagtactgcagacttaaatactgtaccctgtgactttt
ttttttttagatggagtcttgctctgctgcccaggctggagtacagtagtgcgatcaagg
ctcactgaacctccacctcctgggttcaagtgattctcctgcctcagcctcccaagtag
ctgggattacaggtatgtgccaccatgacccaggtaattttttgtattttagtagagacg
gggtttcaccatgttggctagattcgtctcgaactcctgacctcaggtgatctgcccacc
ttggcctcccaaagtgctgaattacaggcgtaagccattgcgcccagtgacatttttca
atatctagtcccatgaactgaatagaggcatttcaaaataatttagaattttataatctt
aattttttcctcaggaaaacccagtcgttgtcataatgttcctctgagttaagaaaatcag
ttgcatacttatgtgctggatatctgcatttccaggtcacttattacttaccatagcagc
aaagacataatggtcattatggcaatattccgagtcctga >IGR3008a
aatagaggcatttcaaaataatttagaattttataatcttaattttttcctcaggaaaacc
cagtcgttgtcataatgttcctctgagttaagaaaatcagttgcatacttatgtgctgga
tatctgcatttccaggtcacttattacttaccatagcagcaaagacataatggtcattat
ggcaatattccgagtcctgaacaggtccagaatgaaagctttctgctgcttcagggggatt
tagctcctgtaaccaaaataatgcaaataaccatgagattaagaggtagtaaggaagtat
ctttggctatgatgcatggggaaaacttatgcatgcaactcccacttcaccttgactatg
cttagaagtctggtgattggaggcaataggcatctacatatatgacacttactctgaca
ctttaaaatgtttgtagtccattttacacagaagcctttaaatatataacacccccttc
cctgtctcgttagacaaagcctgttggctaacatagcctttctctgactgacagtcagag
aatggatgtcatttaccacactgatctgtgatcctcaggactgcctattgaagggtaggg
ccatgtagtcccttccttgaggccacgtctgcttttttacacttctctgttttatttgtttg
tttttttttagatggagtctagctctgtgcccaggctgga >IGR3009a
ctgttggctaacatagcctttctctgactgacagtcagagaatggatgtcatttaccaca
ctgatctgtgatcctcaggactgcctattgaagggtagggccatgtagtcccttccttga
ggccacgtctgcttttttacacttctctgttttatttgtttgttttttttagatggagtcta
gctctgtggcccaggctggagtgcagtggtgtgatctcagctcactgcaacctccacctc
ccaggttcaagcgattctcctgcctctcagcctcctgagtagctgggattacaggcgagc
accaccgcatctggctaattttttgcatttttttgtagagactgggtttcaccatgttggcc
aggttggtctcaaactcctggcctcaagcagtctgcccacttttgcctcccaaagtgctg
ggattacccagccttgcttttttacacttctcttgttgtagtcatttagcatcagaacaga
cttcagtttactggcgggccttgggcaagtaacgatcctctctgaacttcagcttactgc TABLE 5-continued tatataaaatgggtatattaattgggagttgagagattaaatgagatcatatatatatag
cttagcacagtgcttgaaccatggtaaatgtccagtaaatttaaactattattattatta
ctgtatcattgaggaaaagaggctagccatcagcggtcag >IGR3010a
ttgggcaagtaacgatcctctctgaacttcagcttactgctatataaaatgggtatatta
attgggagttgagagattaaatgagatcatatatatatagcttagcacagtgcttgaacc
atggtaaatgtccagtaaatttaaactattattattattactgtatcattgaggaaaaga
ggctagccatcagcggtcagtgacaaatccttactgctatcaatgggtttatactctttt
actttttatttatatttattttcttgtttgttttttgagagggagtttcantcttgttgcc
caggctggagtacagtggcgcgatctcagctcactgcaacntccgcctcccaggttcaag
caattcccctgcctcagcctcctgagtagctgggattacaggcacctgccaccacacctg
gctaattttttgtattttttagtagagatggggtttcgccatattggccaggctggtctcaa
actcctgacttcaggtgatccatccacctcagcttcccaaagtgctgggattacaggtgt
gagccactgcgcccggcctattcttttgcttttaatttgctgatattaacttgctatgag
ttatgaatcaaggtaaccaagctgattagaattgaaactaacataaaagttattaggctc
tgaggtggggaatctctcagggatgaagtaccaggacttt >IGR3011a
catccacctcagcttcccaaagtgctgggattacaggtgtgagccactgcgcccggccta
ttcttttgcttttaatttgctgatattaacttgctatgagttatgaatcaaggtaaccaa
gctgattagaattgaaactaacataaaagttattaggctctgaggtggggaatctctcag
ggatgaagtaccaggactttgtgactttgtggccctacagtgcatgcgcagtaagagact
gatggaggagttttttattatgaagaagtgggagtgccaggcctgccttcacagcaggtcc
tctccaaatgtgagtgtccttttttctaggaatgatcagacacttacacagctcacagcc
acattgcctttctctcttgcactatttggattgtagagccccagaacatgcccccagca
gaataaccctggtattataacaaagcaaagccactgcataaactagtgggaaccagacat
cttcttggagggttccaaggggtggtgcacacagacaggacctgtggaccagtcctgtgct
aatacttggtggttccacgggcccttcttaaatgcaggttgccaggttcctccctgggc
ttgcctacttcgactcttttaaacagaggcctgagaatctgtattcttaaagcacttggg
tgattgtgatgagcagccaggattggaaacctcagaacaa >IGR3012a
gtggtgcacacagacaggacctgtggaccagtcctgtgctaatacttggtggttccacgg
ggcccttcttaaatgcaggttgccaggttcctccctgggcttgcctacttcgactcttttt
aaacagaggcctgagaatctgtattcttaaagcacttgggtgattgtgatgagcagccag
gattggaaacctcagaacaagaatatgcttgatccagtggttgtccctggcctgggtgg
agccaccaaaatgtctttggatcaggtaccagaagcaggttgaaggtgcttcttctgaag
ccaaggatgcttgagattgctttctaagacaatactctactctatatcttttcctatcca
agttaatgctactgcctgtaacatgaagtgaaaaatcacagttgttaagagcatgtactt
tggtgcctgggagaactaggtcacaaatcccagtttaacatctgtgtgatcctgggcaag
ttacttaacttcgctgtgccttagtttcttttttgaaaaaaaaaaaagcatgagcaat
gagcagaacacagtgcctggcatttggtaggctcttcaatatcattctaaataggtgca
tttgctggcacagggctctgcagatcctcctaaagaggatcctacgggaggtgagcaggg
gagatgaccaggcctcaggaaagcgcaagcccccttttccc >IGR3013a
ttagtttctttttttgaaaaaaaaaaaagcatgagcaatgagcagaacacagtgcctgg
catttggtaggctcttcaatatcattctaaataggtgcatttgctggcacagggctctg
cagatcctcctaaagaggatcctacgggaggtgagcaggggagatgaccaggcctcagga
aagcgcaagcccccttttccccttaatgggtttgtccagttcaggctagatgtgcatcatgg
caggaagaaagaaggcactgtcaggctgagaatgatggctcacatctgtaatcctagcat
tatgggaggctgaggtaggaggattgcttgagcccaggagtttgagaccagcctgggcaa
catagtgaaaccctgtctctacaaaaaaaaatacaaaatgttagctgggttttggtggcaa
gtgcctgtagtcccagcttgggaggttgaggtgggaggattgcttgagcccagaaggtcg
aggtcgaggctacattgagctgtaattgtaccactgcactctagcctgagcaaaacagtg
agactcaaaattttttttaaagtgtgtgtgtgtatatatatatatatatatatatat
acacatacacacatatatatacacattttatatatgcgtgtgtgtgtgtgtgtgtgtgt
gtgtgtatatatatatatataaaggcactgccagaaccat >IGR3014a
tgtaattgtaccactgcactctagcctgagcaaaacagtgagactcaaaattttttttaaa
gtgtgtgtgtgtatatatatatatatatatatatatacacatacacacatatatat
acacatttatatatgcgtgtgtgtgtgtgtgtgtgtgtgtgtgtgtatatatatatat
aaaggcactgccagaaccatgtgttttaacactgaactatattcttatttgtccataact
atatatctcatatctatttttatgattgctgtcatccacataggtagatccctacaactag
actctaagtttcacagataggaatcaggccacctagctgataaataccgataaacaccc
agcacagccctgaagggcagaagtgttagacactcccaatgttgttgttgttgttgttgt
tgttgttttatccatttaaattgactgagacttgaaatggacttcttgatttgaagggca
aaggattaagggatgttttgtcctggcagccctctgagagcttgagttcatggccagtct
aagcctctagccatagccagatatctgcttctgaaaaggtcctgaaggccagggactggg
gggaagccgtgggggtgagcagtggcatgccaccgtcctctacagagttctgctttctg
tactacatgctttggtgcagggcatgtataatgttactga >IGR3015a
tcctggcagccctctgagagcttgagttcatggccagtctaagcctctagccatagccag
agtatctgcttctgaaaaggtcctgaaggccagggactggggaagccgtggggtgagc
agtggcatgccaccgtcctctacagagttctgctttctgtactacatgctttggtgcag
ggcatgtataatgttactgaagccaccacagtctttttttaggtgtcctgagcagactcct TABLE 5-continued acctatctcctagacaggaatgccctgccccatcctctccactcatttaagtgagtcctg
ctgtcctccctggcttggacctgcctccagccatgggccaccctgctatctttctctgta
ttgctggcacacagtgtctctacttggatacttaccatttcctcccttatgccattcttt
atcttttatctaatcctcttgccaatcttagttacattctatgttcctttagaatttgg
gctgtgtcttttcttatttcctctaggagccagcacagggcatggcacactgcatatcct
cacgaactgtcaggaggtgtggctgcttccacagaatatcagcttttccttgtggccacc
agctttcaagggtgaatcctcaagcctgtgctttcaggccttaaggttctagacatgaca
cagagtgagactaaagacatgcatagcttcctcagcagtc >IGR3016a
ctctaggagccagcacagggcatggcacactgcatatcctcacgaactgtcaggaggtgt
ggctgcttccacagaatatcagcttttccttgtggccaccagctttcaagggtgaatcct
caagcctgtgctttcaggccttaaggttctagacatgacacagagtgagactaaagacat
gcatagcttcctcagcagtctgtggtaagattcagggtacagtggagaacccagggtgga
ctagccctgaaacatattttccacttaatctggacatttaaaaatcatcagtacatagc
tgtgtcagtggtttggagcaatgccaatagaaagttgatgataaacttgcaaaataaagc
aaactaatatttaatgaacgcttgctatttgctaagcagtttacatatattattgcattt
aattcttataaacagcccctttaaggtggattttatcttagaatttaatcatgattgtgtt
cctaaggcctagtgcaatgcctggtacatagtgggcacttaacaaatattgaattaagtt
aaattccataaaatcaagaatgcatagctgatctcaagaggaaacatctgcaaatgctta
cctccacagaatcaaatatcactgctggtacagctatgttgttcattttgcagcttttt
ggatgatatcttcagcctctctaaatcttctctgggatat >IGR3017a
ctggtacatagtgggcacttaacaaatattgaattaagttaaattccataaaatcaagaa
tgcatagctgatctcaagaggaaacatctgcaaatgcttacctccacagaatcaaatatc
actgctggtacagctatgttgttcattttgcagcttttggatgatatcttcagcctct
ctaaatcttctctgggatatcagccatcggggagattcaggaatgaacctataatttatt
tttaatatttaataattttcacaacagcagggctggatactattaaatctgagtttccc
ccaaatagttttaattttgtaaaattctagtttgtcttttaaagggagtccacataaga
tttctattggagcataggaataaataaaaccaccttcaagtttcaaacttctgatcaaat
tataagaccgatcatcagttgtgcttgagaccaggaccagaccataagggggacattaa
ctatgggcatgtttgagccagggctctggagaagttcatccaaaacttataggtagtgtg
gctcataaaagaaacatagctactagactataagttcccctagaagagactgtctttg
cagtgggtccatcctaaggagaattgctggtgtcccagctggtgatgttcacagtttatt
gggaaaaggatggccagggcacctgtgttcttgatcgttt >IGR3018a
gggctctggagaagttcatccaaaacttataggtagtgtggctcataaaagaaacatagc
tactagactataagttcccctagaagagactgtctttgcagtgggtccatcctaagga
gaattgctggtgtcccagctggtgatgttcacagtttattgggaaaaggatggccagggc
acctgtgttcttgatcgttcctttagtcaaaagagaaagtgagggcactgacacccgcc
tgtgtgggcccccatggctttcaacagattcccagatcagcgagtgcccaaaccagctt
tgggagatgagccccaatgttgtcttttgttaatgtctaaaaaagcttattgttttaa
attacatagtctattcccatttatagctgatgctcaaacacagttgcaaataataggct
tctattctttctaaattttatttctcaaaatcttttagccattctcctgtcagctctca
ttttccttacctattgtcagtacagatggtccctaacttatgatggttcgacttatgatt
tttctactataggagaaaatgatatgcattgagtagaaaccttactttgagtgctcata
catacagccattctgttgttcactttcagtacagtatttaataaattacatgaaatattc
aacacttaattataaaataggttttgtgttagaaaatttt >IGR3019a
tacagatggtccctaacttatgatggttcgacttatgattttctactataggagaaaaa
tgatatgcattgagtagaaaccttactttgagtgctcatacatacagccattctgttgtt
cactttcagtacagtatttaataaattacatgaaatattcaacacttaattataaaatag
gttttgtgttagaaaattttgcccaattgtaggctaatgtaagtgttctgagcatgttta
aggtaggtcaggctgagctatgatatttggtagggatgcagggcaggcaagctccagagt
gggggtttggcccatgagggttcttggctttgcccaggaaagaattcaagggcaaactgga
ggtggaagaaaacagctttattgaagaggcaatgttacagctccgtgactgctcctgcag
agcagggctgccccacaggcagagagtagcagctcaggacagttttgcactcatatttat
aactacttttaattacatgtagatgaaaggtcagtttatgcagaaatttctagggaaagg
gtagtaattttgggtcattgggtcattgccatgaaaggggcaataaagcctgagtgtt
gtcatggcaacagtaaactgacatggcacacgggtgggcgtgtcttatggaaagcgtctt
ctgccctggctgtgttttagctggtcctcaatttggtcca >IGR3020a
agatgaaaggtcagtttatgcagaaatttctagggaaagggtagtaattttgggtcatt
gggtcattgccatgaaaggggcaataaagcctgagtgttgtcatggcaacagtaaactg
acatggcacacgggtgggcgtgtcttatggaaagcgtcttctgccctggctgtgttttag
ctggtcctcaatttggtccagtgtccaagccctgcctctggagtcgtgtctggcctcta
cctcagtaggttaggtgtattgacctagaatattctcaatttacaatgggcttattggga
tgtaaccccattataagtcaaagagcatctgtacttacttagcctagacaacaaattata
agtagcagacacagagtcctgtgtagttaattggccccaaacccacactaggaattagct
cagagcaaaacaaatgaccaaccagcaggtcccctctccagcttaatagcacatgagttg
aaaaatgagcctagtttgcattttcagaatatgcctttagtgggtccctataggaacta
caataatgttaggtcactgactctcagtaattagaactgtgctgtccgatagaaacttct
gaatgttctgtatctgtactaagacagcacccactaaccacatgtagctattgagctag
tgtgattgaagaaatgaaaattcaattttatttacttta

TABLE 5-continued

>IGR3021a
tttttcagaatatgcctttagtgggtccctataggaactacaataatgttaggtcactga
ctctcagtaattagaactgtgctgtccgatagaaacttctgaaatgttctgtatctgtac
taagacagcacccactaaccacatgtagctattgagctagtgtgattgaagaaatgaaaa
ttcaattttatttacttttaattaattttaacttaaatagctgcatgtggctggtggcta
ctatattagtgcagaattagagatcttactacacagccacgatatacctcatggatgggg
ccagtatctttctccaaccagattatgcttagaaatatcctaccttttttttctacagacc
actggcctcagattcttaatgtttaatcagctagaaattgcatagctttcctcacattgc
atctatggcctgcttccctaccccatccccaccgcctatacacatactccattcacacct
gtggccacttactgccaagccttttaaaggaaacttgggacataaaaagtcccccaaacc
accagcagtgcctctatgtaggtttacctcccatttctagcccactgtactcagggccac
tggtatctctagttttgaattgctttgattttttttggtgcacataatctcaaatctag
ctgatcatttcaaaagtcaatggagtgccaaatgaggtag >IGR3022a
cttttaaaggaaacttgggacataaaaagtcccccaaaccaccagcagtgcctctatgta
ggtttacctcccatttctagcccactgtactcagggccactggtatctctagttttgaat
tgctttgattttttttggtgcacataatctcaaatctagctgatcatttcaaaagtcaa
tggagtgccaaatgaggtagcacactataatctctctgtagattgaattcagactaaaca
gcagtgaggtgttgctggagagcttgtctcatactgagcaggcggcagggtccatgtcag
ctctaagcatccctccatacccaaccactagactgatgagcatcccctttgggaagaccc
acctgcaaggatgggatgttcagaagaaagctatttttcttttataggaaaatggtaagac
cactggtaaatgttcaggggagcactcagcttgtcagtgctggtcccaggctggcctct
gtctgggcaagtcctgtccctggtacagtatgcccacagccaggagcattcatggacca
gctcctggggaatagaagaaaagctctccttagggcacagtgagcaggctccctgtggg
atggaccttctctgctggaaactctggaggctgactctggagggctaatggatcagagct
gttcgttcctcgctgtgacatatggtcccgaggcaaagat >IGR3023a
ctggtacagtatgcccacagccaggagcattcatggaccagctcctggggaatagaagaa
aaagctctccttagggcacagtgagcaggctccctgtgggatggaccttctctgctggaa
actctggaggctgactctggagggctaatggatcagagctgttcgttcctcgctgtgaca
tatggtcccgaggcaaagatcccatccctactaatctctgtacagcccatcagaggcttt
atattgttattctctctctctctttctctctgatagaatcatacettaatcagattgatt
ataacttttttttgagacagcatctcattctatctgggctggagtgcagtggcatgatc
atatagcgcactgtaatcttgaactcccaggctcaagggaccctccacctctgcctcct
aagtagctgggactacaggcgctcaccactgcacccagctaatttttttattttttagtaca
gacaggggttttgccatgttgcccaggctggttttgaactgctgggctaaagtgatcctcc
cacctttggcctcccaaagtgctgggattacaggtgtgaatcaccatacctggctaattat
aacattttgaaagtactggtctcttaggtcaaaatgacaactagagccagagaacatagt
ttattaaaaccattcagctgaagaggcagaaaagaacctt >IGR3024a
cccaggctggttttgaactgctgggctaaagtgatcctcccacctttggcctcccaaagtg
ctgggattacaggtgtgaatcaccatacctggctaattataaaccattttgaaagtactggt
ctcttaggtcaaaatgacaactagagccagagaacatagttttattaaaaccattcagctg
aagaggcagaaaagaacctttgaataatcttgtcatgtgtcttgagagaaccttagtcac
taacatcttttccaataaattcagctagcaagggagttgtgggagagaaggacagatgatg
atgatgataattactctcattcagaaaattgctctgctcttgtaagtctgggatgctttc
cttggaggcacagctatgtagataatggccagcccttattcactgctcctcaggccgggt
ttcccggtcctcagacaggggttccagaggaatgttgcaaatcagaataatacataaccctt
taacaaactgtcaactcccctgcacacttcatgccaataatttacactagtaaatcaca
gcactcttacaggtcatgagaatacaggggcttagagtgagcccacctgacctgcgctat
ctcgtcagacaggtggcctgcctgtcaacctctatgactgcctaacagctgcagtaagat
aaaggcctagacagcttcccagtcaggaggtatccaaagg >IGR3025a
ctgcacacttcatgccaataatttacactagtaaatcacagcactcttacaggtcatgag
aatacaggggcttagagtgagcccacctgacctgcgctatctcgtcagacaggtggcctg
cctgtcaacctctatgactgcctaacagctgcagtaagataaaggcctagacagcttccc
agtcaggaggtatccaaaggacagggcaaccatgaggtctagtctaaattgtgagttcca
aaaaatggtcaaagaagcttgtgttatgtgtaagcaggtagaagttatgcagttcggtga
aaccagtcagtgctggaagatttgactttgatataatgaaatcaaacaaagaagaattaa
tgagagagaaagagaatgagagagagacagaaccagacccaccaatggaaggaatctcct
tttctcttgcttaaatatgaaaaagcaaaggaacaggaaatctccaaaaagagggtatgt
ctgacaccttgttctatgattttttaatttattctttcacctgaaatcccccagatagtca
tattgggcaagactgaggccagaatcttcaaactttgttattcctataactgttgtgtta
aaactgagttgggaggttgtgggaggagagaagaggacatttctctaacaatttattaaa
taaaaagtaattttctcactcttcgagacatagcagataa >IGR3026a
ttttaatttattctttcacctgaaatcccccagatagtcatattgggcaagactgaggcc
agaatcttcaaactttgttattcctataactgttgtgttaaaactgagttgggaggttgt
gggaggagagaagaggacatttctctaacaatttattaaataaaaagtaattttctcact
cttcgagacatagcagataaataggcacactatcatagtgctaataaataggcttccctt
tcatagatgctaatcgttatatgataggggaagcttgaagaattacattagttggatagag
tgagattttctagagagagaaaagtgatgaaagagcaggggcagagttaaaaacaaca
aaatccaacaccaccagctccacaaataacaagtagcaacagacaggagtggctggtatc
aaggaagagattggaatcctgagaatgtgcttttttaggacaatggagactcaaactccag TABLE 5-continued cacacaggcccacccacaatgaggcaaaaactctcccggcttggaagctggcctccgcga
gttccgtggaggtcatgcaagcccaggctaggtcagcatcaggctccaggtgtgttccag
gtgtgctgacccgcagcagagggcctgtctggggacgagtcacactcaccaccacagcgg
gacacacagcactcccggcaccgtcagcgccagcagcagc >IGR3027a
gaggcaaaaactctcccggcttggaagctggcctccgcgagttccgtggaggtcatgcaa
gcccaggctaggtcagcatcaggctccaggtgtgttccaggtgtgctgacccgcagcaga
gggcctgtctggggacgagtcacactcaccaccacagcgggacacacagcactcccggca
ccgtcagcgccagcagcagcatccgccagtctctgatgaagtaagcaaacagtggcagca
gcatatagccaactgcaaaaaatgtgcacactcctaatgtagagaatataatacgaactg
acttgccaagaatttctgttcctgttcaaaacaagggaggagtattagcatattaactca
ctttaatatttgctttttatatcattatgtggcagttagagttcaaactatcaccactta
gaaaagggggaaaggcatttgcctcatggcccagagcaggcatggtcagggtagaggaagg
tgggacgtgatccaagacttggcaacttatagaaggttgaatttctatgagattttaatg
gagccatagatttatttatttatttttaattaatttattattattattattattttttgag
acaaagtctccctctgttgcccgggctgcagtgcagtggcgtgatctcagctcattgcaa
cctctgcctcccaagctcaagtgaccttcccacttcagcc >IGR3028a
ggcaacttatagaaggttgaatttctatgagattttaatggagccatagatttatttatt
tattttttaattaatttattattattattattttttgagacaaagtctccctctgttgc
ccgggctgcagtgcagtggcgtgatctcagctcattgcaacctctgcctcccaagctcaa
gtgaccttcccacttcagccttccgaacagctggaactacaggcgtgcaccaccacgcct
ggctaattttgtattttagtagagacgagtttcgccatgttggccaggctggtcttg
aactcctgacctcaagtgatctacctgccttggcctcccaaaatgttgggattacagtca
tgagccaccgcgcctggccaacttattttaaggccattccatgtcataaaaatatcatgc
ccagccccaagagctaatcccttctgagaatgccacatttccaaaataagagccccaaca
tgagaagcagagagagcatttcaggagacaagcagtggctcttctgagggccatgtggg
gtcaaggtgtgtgtagcctttccaacagttctgaactgtaaataaacagacattggccca
tcaggaagcagtggagagttcatcatttccaagacctcagggcacacttacccatgcctg
agccctgagaaatcagttggagtgagctggctctggaggt >IGR3029a
tcaggagacaagcagtggctcttctgagggccatgtggggtcaaggtgtgtgtagccttt
ccaacagttctgaactgtaaataaacagacattggcccatcaggaagcagtggagagtt
catcatttccaagacctcagggcacacttacccatgcctgagccctgagaaatcagttgg
agtgagctggctctggaggtacacagacaggcctcctgcagcatgctgtgcccagagat
cagcccaggcagacacagtccacagtccatttggaccaaggaaagaaaagcaggcgctgt
tctgctgcccctgcaggcagcagcccctagacctgtccacacacccattgaactcacagtg
ctttccctgaacagcagaaaggccatgactgcttggtgcgggcactgcttttttgggaa
ggacatgcaggcgactattggcctctgctctgctcagtgccacagtgagcagcagagatggca
ccagatgggagtccaagaacaaagctccttctcttgtcacggagctctgggcccttcca
cagagtctgcccttggttcactacacctggggcggagatgtgaccaatggcaatggctct
gccttttgttggggatctgcccatgctatagagaagtggcctggaagatacaaaacagat
aattcaaaggtcattcatgcttgccttttaagagagattt >IGR3030a
aaagctccttctcttgtcacggagctctgggcccttccacagagtctgcccttggttca
ctacacctggggcggagatgtgaccaatggcaatggctctgc
ccatgctatagagaagtggcctggaagatacaaaacagataattcaaaggtcattcatgc
ttgccttttaagagagattttctcagtcatgtttatatgccctaggcacaggctaaggga
ttaagagctaattccagagaagcagcaaaattactatgttggctggtttctcattttacc
acctatctgttcccatcccaccccactcattcccttcactgttcataactgagagatct
gcctcagtgggtccctctcaagaggccatttaaaaacctggactgatagaaacagccagt
actttgtgcctcctgcatcccatgttggagacaattgccctaaccacccagagcattgct
cagcctataaacccatttccaaggatagggcctgacttctttgaggatcatgagtatgat
ttccaggtcttttctgacctcattaatgaccttcctgctatgcactggtttctaaacccc
ttggccgtgattgtgatgtggaaataaatagaaggtgctttattcttaagcagagattca
gtggcagagggtttgattttggaaaagagaaagggcgcag >IGR3031a
aaggatagggcctgacttctttgaggatcatgagtatgatttccaggtcttttctgacct
cattaatgaccttcctgctatgcactggtttctaaacccttggccgtgattgtgatgtg
gaaataaatagaaggtgctttattcttaagcagagattcagtggcagagggtttgatttt
ggaaaagagaaagggcgcaggatcaagtgagaatcttgtagaattgtgaggccagaggag
ctttctcctaccttcatgaccttgttaagaaaagagaagttatactactgggttcctgga
taatctccctctctaagcatgggtctcagaccagaacagttatataactttgcagagtgc
atgttggggacagagactttgtaggtctctctctttgccttcctgtggacagcatggatg
gtacaaattgaaataattccttttttagtcctacttttctgctctcttttaggcagtcaccc
ttccttaaacaggatcaccatcttcacagctagcattttttgagtaggtactttgagac
aggttccaggctaagtgtttacatatattatctctttgacccttcacaccagttatataa
aaactaatattccaggccaggcacggtggcttatgcctgtaatcccagcactagggaagc
caaggcaggcagatcacctgaggtcaggagtttgagacca >IGR3032a
tcttcacagctagcattttttgagtaggtactttgagacaggttccaggctaagtgttt
acatatattatctctttgacccttcacaccagttatataaaaactaatattccaggccag
gcacggtggcttatgcctgtaatcccagcactagggaagccaaggcaggcagatcacctg TABLE 5-continued aggtcaggagtttgagaccagcctgaccaatatgatgaaacctgtctctactaagaatac
aaaaattagccaggcatggtggcaggcacctgtaatcccacctattcggaggctgagac
aggataatcgcttgaacccaggaggcagaggttgcagtgagccgagatcatgccactgca
ctccagactgggcaacaagagcgaaactccatctcaaacaaaacaaaaactaaaacaaa
agctaatattcctcctactttacacataattagctgagacttcagagttaaagccaattg
cttaaattcatgcacataataagtggtgcaccaggatttaagccttatttgctctatgga
tactggtctaccttccaagaaaaaaattactgggggcatgacttggccttataaagcagt
tcttcaactgagagtccagtagagacatgaggggagatgggtaaggccatatcctgctgt
cattttttacagtttttcttttttttctttttttttttttt >IGR3033a
aagtggtgcaccaggatttaagccttatttgctctatggatactggtctaccttccaaga
aaaaaattactgggggcatgacttggccttataaagcagttcttcaactgagagtccagt
agagacatgaggggagatgggtaaggccatatcctgctgtcattttttacagtttttcttt
ttttctttttttttttttttgagacagacttgtgctctgttgcctaggccagagtgc
agtggtgcaatctcagcttactgtaacctcttcctcctgggttcaagcgattttcctgcc
tcagcctcccaagtagctaggactacaggcgcttgccaccatgcccggctaattttgta
ttttagtagagacggggtttgccatgttggccaggctggtcttgaactcctgacctca
ggtgatccaccaccttatccccttcagaagtggatttacattttccttccttggct
tgtcactggaagccagccagacccctctgagtaatgctaggagagaaccctgattacaca
gatcttttatggctgcagctgccatgagctttccatgtggcagtgaaacagatgacaca
gcagtgactcctgctgtgctgacggggatccctgtcctggcccccatgctctatctgc
ctcttctgcctgctttgcttctagggcaaagcctggttgg >IGR3034a
accctctgagtaatgctaggagagaaccctgattacacagatcttttatggcctgcagc
tgccatgagctttccatgtggcagtgaaacagatgacacagcagtgactcctgctgtgct
gacggggatccctgtcctggcccccatgctctatctgcctcttctgcctgctttgctt
ctagggcaaagcctggttggtcttggtctggctgggcttctgagtttctcctgggagtga
aactttgacatctaagccaaagggacatgacctggctaggatgagggccagcatagccct
aggagtattgcccaccacctgtcacacccctctgaatctgagcactctctccaagaggga
gtgactcagagagggccaggctgccttccatgtagagcagtacctgcccaggaaccgct
gggcccattccacacagaggcaggacatgcaccttcataaatgaccaacataggctctca
gtagaccccagctcaagaaacaagactgtagtgcagctgccaggatatgaggcgagaccc
aggaaccatgggctaggagtgtcctccatctggcacggggagaacctgggttccttgatg
ctgagttgctactagagtgactgtgataagccgtctttcatggagatattattatgaaga
ctgagatcatgtatgcaaagtgcctaggagggtgtctggc >IGR3035a
caagactgtagtgcagctgccaggatatgaggcgagacccaggaaccatgggctaggagt
gtcctccatctggcacggggagaacctgggttccttgatgctgagttgctactagagtga
ctgtgataagccgtctttcatggagatattattatgaagactgagatcatgtatgcaaag
tgcctaggagggtgtctggcatgtggcaggtgctcagtaatagttattctttatcctgat
caagcagttgaaatgtgctacatgtcaggggagtgatggaaagtacaatgcttttgatcc
aaaaaggcccagtggaagacagaactcctcttcagggcttaacagatgttcccctgctca
gggcttcccctctgtctgcaccaatcactccagtcaaaagtaacattcctatctctgtg
tacccagcaatatgtgccccactcccttgacccatgtccccatgtccacagtgacagc
tgcattggctgcagaggcacaaccaggcagtgagctccttgtgaatagacaggagtaagt
tcttgctcttccctgggtctccccagttcttccctcttacggtgcaatgcaaataaggta
tgccagcaaattctgcatcatgtttacgtatttatatgccagctcatcccttggagatt
ttgaggcaacttcaaatttaaatacaataaaataatggta >IGR3036a
aaccaggcagtgagctccttgtgaatagacaggagtaagttcttgctcttccctgggtct
ccccagttcttccctcttacggtgcaatgcaaataaggtatgccagcaaattctgcatc
atgtttacgtatttatatgccagctcatcccttggagattttgaggcaacttcaaattta
aatacaataaaataatggtaacattaaagtaagatataaagaaaagtaaaagttgtgcc
ttggtgaaaagatcaaaaatacgcagctgactattttgaaaacagtttggcagttcctca
aaaggttaaatatagaatcaccataggacccagcagaggtcctaccttatacccaagaga
attaaaaacatatatccacaaaaatacttattctccaatgttcatagcattattcataac
agccccaaagtagaaacacccaggtgttcaatgactgatgaatggatgaccgaaatgtgt
tgtcttcatccagtggaatactaattcatgttacaacatggatcaaccttgaaaacaagt
gggagtcagtcacaaaggccacataatatatgattctgtttatatcaaatgtgcggaatag
ggaaatccattaaaggcagaaagtaaattagtggttgccaggggcgaggggaagagggaa
atgactgctaattcgtatagggtttcttttcagggtgatg >IGR3037a
ctaattcatgttacaacatggatcaaccttgaaaacaagtggagtcagtcacaaaggcca
cataatatatgattctgtttatatcaaatgtgcggaataggaaatccattaaaggcaga
aagtaaattagtggttgccaggggcgaggggaagagggaaatgactgctaattcgtatag
ggtttcttttcagggtgatgaggagttagatagtgttgatggctgtacaactttgtgaat
atgctaaacaccactgaattatacacttaaaagtgtgaatatcatggtatgcaaatctg
tcatggactgaatgtttgtgtccctctattattcatacattgatccctgacctgatagg
gtataggattagtgttcttacaagaagagacaccagagagtgagctctctatggctcact
ctctctttcttgctttccctcttttctgagcacttgcgcagaggaaagaccatgtgaggac
ttagggagaaggcagccatctgcaacccaatgggagaaccctcaccagacaccaaccctg
ctggcactttgatcttggacttctaccctccacaactgtggaaaataaattttggttgtt
taaaccacccagcctataggattttgttacggcatcctaaacaggcgaagacaaaattat
atttcaactgttcaatttaaaaacagtaaaaaatatatat TABLE 5-continued >IGR3038a
tgcaacccaatgggagaaccctcaccagacaccaaccctgctggcactttgatcttggac
ttctaccctccacaactgtggaaaataaattttggttgtttaaaccacccagcctatagg
attttgttacggcatcctaaacaggcgaagacaaaattatatttcaactgttcaatttaa
aaacagtaaaaaatatatatatatgtggctggtaaaagctgcatcattgatgtagttaaa
tttcaaatttgcctgagcttcctggtagccagagttgtaaaggaagatgccatcacttac
acacctatcaaaaggaggaacctctagacatcagaggaagcaaagctttaaatggttcag
catgcccaaagaaatgtcacatggaggttgatgttagaagtactgaaaaatactgaatta
atgaatcagtcaagagtttttttctgtgttattaaatacagaaacactttttgtgtttaag
cagctagttatggggataagagaggatactgatggcattctacccagaaggctattgac
aggtggagggcattatttctgggcaacagtaggagattgtgaggggagctggaacgtggg
tagggttagtgtccttggtcccgagtggtcatttcctcctaaaccagcatcattccggca
acaccatcacttccaggcatgtctgctttatgctgtgtag >IGR3039a
gagaggatactgatggcattctacccagaaggctattgacaggtggagggcattatttct
gggcaacagtaggagattgtgaggggagctggaacgtgggtagggttagtgtccttggtc
ccgagtggtcatttcctcctaaaccagcatcattccggcaacaccatcacttccaggcat
gtctgctttatgctgtgtagggtagcactgttctttctttctctttttctagtctgctacg
actgtggcagccttgatcatttttaaaagcagcacaaaacaaggactcatttctgcact
actttgacagtgggagtaatttggcttcccaagttaatgtgaaattatcatgcagagctt
tgccaaccttccttagggccagagggtggaagcgaaggcacctaccaaactcctcagcc
cagaccacacccttggtttattttagtcaaatacaacctggaattcagctatttttatcc
cagaaacaccagagagcactgctgcactgtagggaagctagcagccaccttgcctttgta
ctgtgtccccaaccccaggtgctgactgggcgtccagccattccagagcaggctggtt
ttcagggacacttaaactttcagacctgagaacccaacacaacgagtctcataccaggat
acaaaagccagtaatttcctgcagagcacaatggagtaaa >IGR3040a
gctgcactgtagggaagctagcagccaccttgcctttgtactgtgtcccccaaccccagg
tgctgactgggcgtccagccattccagagcaggctggttttcagggacacttaaacttt
cagacctgagaacccaacacaacgagtctcataccaggatacaaaagccagtaatttcct
gcagagcacaatggagtaaaaactaccatgaagaggctcccagagcaccctataacaggcc
tggccccaggctgatagcaagccctgagaggcctggatcccagctgatagcgaggctgct
gcacccaggtcttacctactgactggctggcttgactgatcttccatggccttactttc
cccttggccctcttacccttcttcaccctgcatgtgggaccacatgctgcatgggaactg
ggaggagagtagatgatagtgtcagagccggcgggggagggcagcccttcctgtaggaa
gcctgggtatgctctccctgcctcacccgctcacacaggggaggcttggaggctccaga
atcaccctgtgccactaaaaggcagatctcagtgctgcccattctatagaaccggggat
gccaccacctggcacaagtcccaccttgttcccattcccacggagagagcttctctggct
tcaccgtgactctctacccttctgttccagatggtccttc >IGR3041a
gcctcacccgctcacacaggggaggcttggaggctccagaatcaccctgtgccactaaaa
aggcagatctcagtgctgcccattctatagaaccggggatgccaccacctggcacaagtc
ccaccttgttcccattcccacggagagagcttctctggcttcaccgtgactctctaccct
tctgttccagatggtccttcaggtcctcctgggatatgggcctgctggtcagagtcctcc
gttttggggaggcctgtttggcttttggtatgtgtctggcccaagcagagccacatgttg
ggtttttcaggcttagggaggatcgtcacatggaagatggattctggggactttgaacat
gaagacaataggctttgccttgtgttcttggagccactggggactaggaggttgcaattt
ctatcttaagttcctccaacctccagtttccaacaacactggcctgaagctccctgtgcc
ctctacacaaatgatcttcaagaaaatcttgccccgctccttcccctgcaggaagggga
gcagcctcctcccgctgggcctgctgaagagtgtgctacctgctgggaccatgtggctc
cagcatgttcttcccaccttgtctcctccctttctcccctctgcagacactgaggctgagc
ccatggcacggggctcttcgcaaataattaaaggagtaga >IGR3042a
agaaaatcttgccccgctccttcccctgcaggaaggggagcagcctcctcccgctgggg
cctgctgaagagtgtgctacctgctgggaccatgtggctccagcatgttcttcccaccttt
gtctcctcccttctcccctctgcagacactgaggctgagcccatggcacggggctcttcg
caaataattaaaggagtagagttgaatatttccatcctggcaacttgacagaaggtgta
cacaccatcaattaagacagtgcagcatctccaaagccaacgagtccttcagactcttaa
aaagcaatcagagtcacctaaccagattcggacttttgaggcaagaagaatcgttagact
tctattaaaggagtattattaataatgacactgtggacaatagggacaaattgggatggt
actgagccacctagaatatattatcaccctagagatgatgggaactggtgtctactgtcc
cagggatacccctcacctctgcttctctcatttgcccattcgctgggctcaagagaacac
actctctcactcctgtggatgaccctcatcaactcgcctggagctcacctaactccctcc
caggaaaagctgctgagggccccagggacctcttcatgaccttgtaactgatgagtcttc
ctcatgcagcctgacaggagatggggctatcagtgtgggg >IGR3043a
gcttctctcatttgcccattcgctgggctcaagagaacacactctctcactcctgtggat
gaccctcatcaactcgcctggagctcacctaactccctcccaggaaaagctgctgagggc
cccagggacctcttcatgaccttgtaactgatgagtcttcctcatgcagcctgacaggag
atggggctatcagtgtggggaggcttgtcctgtgcttagctgataggctctgggtgggc
tctaactcaggtgaggccagataggcccagtgatggcgggctggcactgaactccccct
gtctgacatgagcctccccacctgtgtactggccacagtgactaccctaagtctcttcac
aagcaaccaggaagaagtctcaagcctacacaactcagatcaaagacatcctcaggctgc TABLE 5-continued ccttcccctaaactgtcctcctctgtgcctctcttaagccctgtgctccagagaatgtgt
ctcagctgttgtgcagctggttcttaatggctcctgctcttcttctccaccacatttcag
ggctcagcacagaggtggctccctgcgagtgcctgccctgccctgacttgctccaagag
ctgtgggctacggctccctcccaagacacatatatccaaaggctttggaagcacagcccaa
tggcccaatgatttcctctttctgggccttcagagggtt >IGR3044a
ttcttaatggctcctgctcttcttctccaccacatttcagggctcagcacagaggtggct
ccctgcgagtgcctgccctgccctgacttgctccaagagctgtggctacggctccctcc
caagacacatatatccaaaggctttggaagcacagcccaatggcccaatgatttcctctt
tctgggccttcagagggttagagggaagcacccatgtcccagaagccattcctaccta
gtatgaaggctaccacatagttggagatctggccatgcccacgatgacaaataacacag
tgaacatctcccagctgatggagaaaatctgcaggaagctgaagccagtctgtacagcca
tggttgcgaagagaacgttcttcctgccaaacctagagaatgcagtataacacaaaacat
gagatgtgtaggttgccaaggtgtgttgcaagccctgagtcaggcatcaatgcagactta
gtgttttttcagggctctggcagacttttttctctgtcacatcctcccatcttcctcctt
ggtgaggtctcaggcatccatctgctcaggagatatcttttgagattctcagcttcctgt
ggagacaccatgtctcaaaagcatggagcagtgtacgcaaggaccttgtggaaatatgct
ctttagaaggagccacagatagatgctaccagcacatttc >IGR3045a
cagacttttttctctgtcacatcctcccatcttcctccttggtgaggtctcaggcatcca
tctgctcaggagatatcttttgagattctcagcttcctgtggagacaccatgtctcaaaa
gcatggagcagtgtacgcaaggaccttgtggaaatatgctctttagaaggagccacagat
agatgctaccagcacattctggaaagtgggtacagcacagattgcagatatttcttgaa
tcagcaacatgaaaattctgtaaatcagaactaagagtcactctgcaagtggttttttaa
ccttggctgcacttggaatcacccggagagcttggaaaaaatactgatgccagcacccca
cctcccaagattttgggatacagtttgggtattaggatttgggaaagtttcccagatgag
tagcgtgcaacaaaaattgcaaaccactgctctgtgggaaggtgagctttcagcaatgt
ctgttggtgacactgaagttgttttaagtattatcttcacattctggtagtgaccagtgg
atagaatggagcacaggtgtgagcagaacagcctttcccgcccattttccaaactcatg
tctctggctgttggcttgggctggaggctttccccagcattgccatttagtaccccac
cttcctgcactggtcacccagcacatacaggggcctgtgg >IGR3046a
gttttaagtattatcttcacattctggtagtgaccagtggatagaatggagcacaggtgt
gagcagaacagcctttcccgcccattttccaaactcatgtctctggctgttggcttggg
ctgggaggctttccccagcattgccatttagtaccccaccttcctgcactggtcaccca
gcacatacaggggcctgtggaatactgtctcctggtgctgtgatgctgcctcctcaggcc
tgtaagctctatgagggtcagagccagcatcagctctgtggcccagtgcctggcccagg
gtccaagccacagcagcagtgtgtgcacagttggggctcactgtctggctgctggctgtt
tgcagacagatcctgtgccatccaccccctacccctgaggtggtggtggagcagggagggc
agtggtgatggcagcgtcatgttttgtcaaggagtctgtggtatgaggaccccactttcc
agtggggtcagtggcccctccccaccactggccaaagccctgggagcatgaggctgggag
aatggaacaaaagtgtgtccaggtgaaggggactgagggcgggtgaataggagacatcg
gggctcctcctatcactgaatcagtggcctgagggtcctcccttctctgggtagaaata
ccctgaattcagtccagccccaagataggcagtgattgac >IGR3047a
cccaccactggccaaagccctgggagcatgaggctgggagaatggaacaaaagtgtgtcc
aggtgaaggggactgagggcgggtgaataggagacatcggggctcctcctatcactgaa
tcagtggcctgagggtcctcccttctctgggtagaaataccctgaattcagtccagccc
caagataggcagtgattgacaaggggcaccatcccaccttcctccctcccatgtgctta
cctgtctgacagctgcccggacacgaaggagccgaggagcacgcctacgaagaacaggga
ggtggtgaggggcaccttccagttgtcctcacacaccagattccactgccaaggaagaca
gcatgaagcgtgagcccaaccctgaggcagacctcaaccccagcccagctctgagggaat
attagcacggctggcgggcagactctcctcccctgggccaggatattgcctttgtacaaa
gggcataggccttgcagccctgggtttgactggcctgtgccgggactggggagagtaacc
tggggcaggtcactgccctccctgaaactcaggatcctctttggaaaggagggtgatgc
tcctactccgctcgcattacatagcaagaagccagccaaggccatggctgtgactggtga
cccctcagctgtgaggcagtccaaagtaaaggtggcactg >IGR3048a
tgggtttgactggcctgtgccgggactggggagagtaacctggggcaggtcactgccctc
cctgaaactcaggatcctctttggaaaggagggtgatgctcctactccgctcgcattac
atagcaagaagccagccaaggccatggctgtgactggtgaccccctcagctgtgaggcagt
ccaaagtaaaggtggcactgcatcttcagaagccagcctagtgcggagggagggtgttttg
aaaagcccaaagggcagggcagagggcatggccacttggtccaggcgtaaaatttctttt
cccttgttgaaaagtgcaagtggttccaggagctctgtgactttattttctgagcaggcc
cctctgagaaatcatgtggtccctggtccactcacgcctaggccaagcttgtggcctgat
tcggggcccatcgttctggggcctacttactcctctccagggctccctagctcccctcc
tacatccctacaccctccttcccatccagtctttccagaagtgtggtccctcccattccc
tagggtctgtgggatgctgctgccctaacaagtccctgccagtgcatctacaaaatgagt
ttcagccagagtttcagtttgacttaagtcaattaagcaacatctcaagggaggtgacaa
aaatttcaaagtgtgtttagtgaccttcatttattaaaa >IGR3049a
cccatccagtctttccagaagtgtggtccctcccattccctagggtctgtgggatgctgc
tgccctaacaagtccctgccagtgcatctacaaaatgagtttcagccagagtttcagttt TABLE 5-continued gacttaagtcaattaagcaacatctcaagggaggtgacaaaaatttcaaagtgtgtttag
tgacctttcatttattaaaaacaaataaataaacaaacagatgccaatgagcactttggg
cttggttttgggggctgctgtctgtggcgagatgatccagtctggaggaaagaccctg
cctcccaccagccctagctccatcttggatgggctgcttttactgcattcgccaaaca
attccttctgaatcctcacaactcccttgaaagtgtggtggatttaagcacaaactcaca
tatttatatcacaccttattctgcagcagacagaggtgtttataaagacacacacaagag
aaaaatgtaaaacaaaagctaagggaattggggaaaatggaaaataaagaggagggaag
ttgcaaaaaccaagcctggggtaagactgaccctagactatcctgtccacgggcctgcct
gcttgccagacggggctccaaaactggctctgcgtatcccagcagctcagctctcagaag
ggttacagtatccgaagtagtctgcttattcgcagaagca >IGR3050a
taagggaattggggaaaatggaaaataaagaggagggaagttgcaaaaaccaagcctggg
gtaagactgaccctagactatcctgtccacgggcctgcctgcttgccagacggggctcca
aaactggctctgcgtatcccagcagctcagctctcagaagggttacagtatccgaagtag
tctgcttattcgcagaagcacagttgttctgaatactgagatccgaaagaagtgtctcct
atgtacttcttccacaaaggagccactctgtgatgctgaggataatgtcctcgagaatag
tcctgtcctagagacaatagcaagattcatgaggccgcctgtcacagtgctcaaatgctg
gccacaggcaacgcccaacacagctctgcagaagaaaaacaactcgggccaggaagttag
cgctctgctgctcaggcacaatccaaggataaatctcagactgtacccagagcaggattg
cctcgcctggggctcttgcatgggcttcaggagaaagggaaatgaatcctctaaaactgt
atggccagattaatgtgttctgccagtccatagaccggaagtggtaaacaggacgtgtgc
ctgcattcatggccatctccctccaaaaataattgtccaaagcttcagataaaagcttgg
gttctgcttctgacttagagagatgagcaattgaggccca >IGR3051a
tgggcttcaggagaaagggaaatgaatcctctaaaactgtatggccagattaatgtgttc
tgccagtccatagaccggaagtggtaaacaggacgtgtgcctgcattcatggccatctcc
ctccaaaaataattgtccaaagcttcagataaaagcttgggttctgcttctgacttagag
agatgagcaattgaggcccaaagcctcatgatgtggtgtgacccattttgcagaagatta
aactgagactgtgagaatgggatttgtctgaagtcatagcaagtaaatgagcatgataga
tacctacttgggcctcagaacccaatcttgtaccagtgtcctgctttggacctatactcc
ctaaggcaggacaaaatgagcttattaaatatgatgccctacacttcttcaaggaatgtg
ataccaggagacaattacccaggactaggagtagaaggcctccatcacagcctttagcct
cagactgagccaagaagaactcaagattggtagaggcattaacatgccaaccatcatcat
tccatctgcagttgagcagaaaagctcttcaaatataatgtgctctcctttgtagtctg
tcaaatattttctgtctggactttgccttagggcaggatagataggatttagagataga
aaggaatggaaggctgttagatgtggagccaggcattgca >IGR3052a
tcaagattggtagaggcattaacatgccaaccatcatcattccatctgcagttgagcaga
aaagctctttcaaatataatgtgctctcctttgtagtctgtcaaatattttctgtctgg
actttgccttagggcaggatagataggatttagagatagaaaggaatggaaggctgttag
atgtggagccaggcattgcatgagcaaagggtaggactgggaactggctacttaatttgc
aaggtccagggcaaactgaaaatgcagaactccttggtcaaaaattattaagaatttcaa
tacagcaatggcaaagcattgaaaccaagtgtggcgctctgtgtgactgcacagttgcat
gcccatgaagctggccctggcaggggatcaaacctggcctccaggaaatgaagcagatgc
aggagttctgaatgggacactgggaaggggggtgaggtgagggccatctcccatcattc
tccttcctgtaggctctgcatcgatggctttcggtcccattccctccctgaagaggggcc
caagaagccctgtcagcatcatgcagcacaggaagagccatgcacacgcagtggccgttt
gccccaagcccatgagggtgccatctgcctttggagaccctgcttacaaccagcagggg
aaggcagctagactgcatggctgcccatggttgattctag >IGR3053a
tcgatggctttcggtcccattccctccctgaagaggggcccaagaagccctgtcagcatc
atgcagcacaggaagagccatgcacacgcagtggccgtttgccccaagcccatgagggt
gccatctgcctttggagaccctgcttacaaccagcagggaaggcagctagactgcatgg
ctgcccatggttgattctagggctgggctctcctttggggagttatggtgccgcaagtgt
cttttttggaaagctgtgaggggcctggtattaggacacaggattggcagatgaagttcta
cctggagcgaagggctagagtccagtaaatcagctgccagtcctaagagggtcctttag
aaaaggcttttcttaggaaaccggccctgcctgcccctgggcccttcaggtttgagggat
atgtcttgggtctccgctagccagggccacaaaacctccctgtggttaacagtgacatgg
cgggcccagtgggagacagtgttttccttgatgggacagacctgtccctgtgggtccctg
cacatgtttgtacatacatgcacacacacatacatacacatgaccagctcagaggctaat
ggcagatgtcctggtaaggagctggctggcattgctttgggggtgtgctttcaagtcaaa
tcctaacatttctgaaacatagcttacctcccctctccct >IGR3054a
gttttccttgatgggacagacctgtccctgtgggtccctgcacatgtttgtacatacatg
cacacacacatacatacacatgaccagctcagaggctaatggcagatgtcctggtaagga
gctggctggcattgctttgggggtgtgctttcaagtcaaatcctaacatttctgaaacat
agcttacctcccctctccctgccctctgatgggccctcccggggttactgtctctgtcc
catcagcagggtcccagaccaaggttctcacaacagagcagagtgagctccatttagctg
ggccgcatgcccttcagctctaatttaagaaacaaaaatccaggtgacaaggtaataggg
gataggaggtcactcttggcatagaaggatgtgccgcttcccatggctccctatagtaaa
gggagtaatgggaaagacagtaacagtgtgtggagtgctcactgagtgccgtgtattatc
tcaggggatctcaggggttggcatgtgagatgggtactcttatccttgttttacaaatgag TABLE 5-continued gaaatgaaggcacagagcaataaagcaaccagcccaagttctcctagtgaattggtaaaa
aaaaaaaaaaaaaaaaaaaaaaaaaaaaaaaaaaaattgcttaatcattgattcaactgacat
tcagcacctacctgctccaggccaggctctgtgtagggca >IGR3055a
catgtgagatgggtactcttatccttgttttacaaatgaggaaatgaaggcacagagcaa
taaagcaaccagcccaagttctcctagtgaattggtaaaaaaaaaaaaaaaaaaaaaaaa
aaaaaaaaaaaaattgcttaatcattgattcaactgacattcagcacctacctgctccag
gccaggctctgtgtagggcacaagaaagacatggtccctgccctcacaaagctcaaggtc
aagcatactttacaggacagatgtgcacatgtgcatgcatgaggccagcagccctgggtg
gggtgggcgctgttctggccacttcacccttgctctttggctagagaggaaagaggcac
cccctcctcaccatcctccagcagaaggacagagttctaaaacctgaataatccgtataa
tcatattttagatgactagtgtttgcacagtgctaggcacacagtgggtgcttaacaaat
tgttgaatgaatattgaacaattaattaggagtcatagaaaatcagcctggaaaatgtgg
ttcttgggctgaggagtatcacgcattgcacttggaaaatcaccctcagccttgaactaa
ctctccaagtagccaaagtctggcagttttagttttaccagagctataaaggaccataa
agataagtgaaccccgtctgacctgcacggaactgagaac >IGR3056a
attaattaggagtcatagaaaatcagcctggaaaatgtggttcttgggctgaggagtatc
acgcattgcacttggaaaatcaccctcagccttgaactaactctccaagtagccaaagtc
tggcagttttagttttaccagagctataaaggaccataaagataagtgaaccccgtctg
acctgcacggaactgagaacgctggaaggtagcctggtgttcagcaaagaacacaggctt
tctcggggtctgcaactttggactgtgtgatgttgggcaatccattcacctctattagcc
tgcttcttcaccttcaaaaagatgacaataatacctgctcctaggtttgttgttgtgcatt
ggatgggaaatatcagtggagcgtctgacacattacaggcctcattaaatggtagttccc
tttctaccaggctcatactagtagagcattttatttgtcctgagcaaaatcatgacttgg
aacacatggacgaataagcaaagcaggttacacttaaatctgactaagagaaagaaattc
taagaaataaaaattattccagtccattactaaaagctagaaaagctcttataaaaggga
tttgataaatggaattcaatcccagagatgactgtgagtgaaaaattagcaatggtcctt
ttaagaataaaagattgatttctatagtatcctctcatag >IGR3057a
aagcaggttacacttaaatctgactaagagaaagaaattctaagaaataaaaattattcc
agtccattactaaaagctagaaaagctcttataaaagggatttgataaatggaattcaat
cccagagatgactgtgagtgaaaaattagcaatggtccttttaagaataaaagattgatt
tctatagtatcctctcatagttatcctttattctagagaaaagtaagaagtagtagttaa
taatggactatacatccacccccagttctatctttgtcacttgattgtgacttaaagctgg
gaattccttgacaatatgaaaaaacaaaacaaagaaaaacaaaaacaaacatggctagtt
aattactttttttgtaacaactttattgagatatgatttatacaccataacatttactctt
ttaaagtatacaaatcaatcattttttagtatattcacagacttcagcaaccatcagcaat
gatctgattttagaattttcatcacccttgaaagaaaacccatacctgttagcagtcact
cctcattcgctacttcctctagcccctggaaaccactaatctactttctgtctctatgaa
tttgcctattctggacatttcatataaatggaatcatacaatatatagtgttttatgact
ggcttcttatacttagctccttttctaagtccatccatgt >IGR3058a
atcacccttgaaagaaaacccatacctgttagcagtcactcctcattcgctacttcctct
agcccctggaaaccactaatctactttctgtctctatgaatttgcctattctggacattt
catataaatggaatcatacaatatatagtgttttatgactggcttcttatacttagctcc
ttttctaagtccatccatgtcattgtgcagtgtatcagcacttcattacttttttatggtt
taataatatgccatggtttgggctgggtgcggtgggtcacacctgtaatcccagcacttt
gggaggccgaggcgggtgggtcacctgaggtcaggagttcaagaccagcctgggtaacat
ggtgaaaccctgtctctactaaaaatgcaaaaattagctgggcacggtggcacgtgcctg
taatcccagctacttgggagactgaggcaggagagttgcttgagcctggaggtggaggtt
gcagtgagctgagatcacaccactgcactccagcctgggcaacaaagtgagactccatct
caacaacaacaacaacaactatatatatatatatatatatatatatatatatatatatttc
acggtttgggtctaccacgttttcaatgatctgttcatcagttgataagtagttgggttg
tttccacttttttggctactatgaataatgctgctgtgaac >IGR3059a
cactgcactccagcctgggcaacaaagtgagactccatctcaacaacaacaacaacaaca
actatatatatatatatatatatatatatatatatatatttcacggtttgggtctaccacgt
tttcaatgatctgttcatcagttgataagtagttgggttgtttccacttttttggctacta
tgaataatgctgctgtgaacattcatgtacaacattttgtgtgtacatgttttcatttct
ttggggtatatacatagtagtgaaattgttgggtcatacggtaagtatactcaacctt
ttgcagaactcctaatctgcttttccaaagtggctacaccattttacaatcccaacagcaa
tgaatgagggtttcaatttctccacattcctaccagtacttgttattgtgtgtctttaat
tttagtcattgtagtgggtgtaaagaggtatctcattgtggttttgattgcatttctcta
ataactaatgttgaacatcttttgcattgaatctattgatcaatttggagagcactgcca
tactaacaataagtcttctgctccatgaacagaacatgggaagcttttccacttgttaag
gccttctggaatttctttcaatgacattttatagttttaaagtatacattttgcaaatt
tttggttaaatttatttctgaagtgcctccttaatattt >IGR3060a
tttgcattgaatctattgatcaatttggagagcactgccatactaacaataagtcttctg
ctccatgaacagaacatgggaagcttttccacttgttaaggccttctggaatttctttca
atgacattttatagttttaaagtatacattttgcaaattttttggttaaatttatttctg
aagtgcctccttaatatttcttgtaagacatcactgctagaaacaattctctcaagttt TABLE 5-continued tgtgtattttttgaatttctttatctcagttttgaaagacagttttgttggatgcatgatt
cttggttgacagtttcttttttccttcagcacttagaatatgccactccactgccttctg
tcctttatggtttctaatgagaagtcaaacgttgatcttattggagttctcttgtatgta
cctagtcatatatttgctgctttcaaaattttcccttcgtttttgtctcttttttttattt
aagcagttttaccatgatatatcagggtgtggatctctttgtgatcattctatttggagt
ttgttgagcttctgaaaggtgtagattaatgttttccaccaaatttgggaagttttcagt
cattatttctttgagcattttttctgccttttctctctctcctctcctagtaattct
attatgcatatattgctatgtttaatggtgttccccattt >IGR3061a
atcagggtgtggatctctttgtgatcattctatttggagtttgttgagcttctgaaaggt
gtagattaatgttttccaccaaatttgggaagttttcagtcattatttctttgagcattt
tttctgccttttctctctctcctctcctagtaattctattatgcatatattgctatg
tttaatggtgttccccatttctctgagactctatacattttcttattccttttcctc
tctgttctttggattgcataatttccaatcctctatcttcaagtttgctgattcttttctt
ttgcctgttcaaatcttctgttaaggcccttgagttacttttaaatttcaattattgtat
actttactccagaagttctattcagttgttttgtttgtttaagagacaaggtctctttc
tgttgcccaggctgggttgaactcctgggcttaagcaatcctcctacctcagcctcctg
agtaactgggactataggcacatgccatcatgtctggctcagcttttaaaaatataaatg
taattttctctctttattgctattctctatttgatgcaatattgtcatcatactttttaa
aagcatgacttcctttcattctttgaacatatttataatggctgccttatgccttaaagt
ctgttaaaatctgacatgtggaccctctcaggcagttact >IGR3062a
catgccatcatgtctggctcagcttttaaaaatataaatgtaattttctctctttattg
ctattctctatttgatgcaatattgtcatcatactttttaaaagcatgacttcctttcatt
ctttgaacatatttataatggctgccttatgccttaaagtctgttaaaatctgacatgtg
gaccctctcaggcagttactgttgcccacgttttccccccatgtataggtcatatttttc
tgtttctctgcatatctcgtaatttctggttaaaaactggacatttttagataatatattg
tagaaattaggtactgtcacattcttccacccccatttccctgatctttcttcttcttct
tttccgagatgaagtctcactctgttgcccaagctagagtacagtggcatgatctcggct
cactgcaacctccacctcctggttccagcaattctcctgcctcggcctcctgagtagct
gggattacagggacctgccaccatgcccagctaatttttgtattttagtagagatgggg
tttccccacattagccaggctggtctcaaactcccggcctcaggtgatccaccccgccttg
gcctcccaaagtgctaggattacaggcatgagccaccacgccagtctgatctttctatta
agctgtctgtgtctgctggtatcacacccagctgttagcc >IGR3063a
ccatgcccagctaattttgtattttagtagagatgggggtttccccacattagccaggc
tggtctcaaactcccggcctcaggtgatccacccgccttggcctcccaaagtgctaggat
tacaggcatgagccaccacgccagtctgatctttctattaagctgtctgtgtctgctgca
atcacacccagctgttagcctcactaattgctagccagttgcctcattcatttcaataat
gccctgggggcatatattgtcccacagtctaatccagttgacgtcaagcctctttgcagt
ggtagttttttgaggcaaatctataaggtttgttttgactccagaagggctgctcttagct
gtctctttcttgttttgtttgtttgttttctgttttttcctggtaaactagctgca
ttatgggttcatttgttgctctaatggagttaccagaatcctttagttgcttaccacta
aattctccattgttcttgagagcaatcttaggctgtcctttcacacactctatttcaaat
aaagttcgttcctgtggggacagctttagaactctgttcttttggattatctctccccgc
tgggcaaaatatctgagctcctgttgtagagaggtaggcagggaaagcggcccatttatc
tcagaatgacacccctactttatgagtcagacactgagtg >IGR3064a
agcaatcttaggctgtcctttcacacactctatttcaaataaagttcgttcctgtgggga
cagctttagaactctgttcttttggattatctctccccgctgggcaaaatatctgagctc
ctgttgtagagaggtaggcagggaaagcggcccatttatctcagaatgacacccctactt
tatgagtcagacactgagtggaagtgggagcttggtgtgaatctctgccgtatgaatga
gctgggataagggcaatcaaggctctaatattctcaacttgtggcacctggagtagagtc
tctactatatgaataggcggtgggtgggaggatgggaacctatgatcccctggttgcactc
acgaggattttaccttctgtggtttggagctaagagaatacagggatgggtgggggatgg
gcattggttgtccctcttggtgggctgctgtagcccttccttggaagctgatgggagaga
gaacagtattttcttggccatacccacctagagtggaacttccattttcttgtgctggg
aggaaggggaagggagggctgaaggagttatgactcaaatatcatagacttcactgttc
ttgccaaggtatagtcgactttcttgaataaatatatgccttaggacaacttccagaga
ctctaaatgtgtgtgtgtgtgtgtatttttcaccagtta >IGR3065a
tacccacctagagtggaacttccattttcttgtgctggaggaaggggaagggagggc
tgaaggagttatgactcaaatatcatagacttcactgttcttgccaaggtatagtcgact
ttcttgaataaatatatgcccttaggacaacttccagagactctaaatgtgtgtgtgtgt
gtgtgtattttcaccagttatggctgtttcactgaggagctggtctatggcgctggcgct
cctcacactgctaacttcgaagtctcagaatcttttcatgtgctaattgatttgtatttc
tttggcaaaacatctattctccaaaatgggcaaatgattttatccatttttaaatcaggt
tgtcttttattgctgagttatcagagttatttttatattctagatacaaatcctttatc
agatatatgatttgtcaatattttctcccatttttgtgggtatctttttggctgtttaat
tcttctactcatattttcatttacaaacaactaagccagaaggctgctaagccttaaaat
gttctcagtatctttctttcttatattagaaaagctaccacagatggaaaagcctcact
gatgagttctgtgatcattggaggctaaaccaaagcagaagaaccagtgagtgtgagtgg
gaagatagggatgggagtggagggctgtgggaaggagaa TABLE 5-continued >IGR3066a
ttacaaacaactaagccagaaggctgctaagccttaaaatgttctcagtatctttctttc
tttatattagaaaagctaccacagatggaaaagcctcactgatgagttctgtgatcattg
gaggctaaaccaaagcagaagaaccagtgagtgtgagtgggaagatagggatgggagtg
aggggctgtgggaaggagaagggtcactcagggacctggctgtgcccttgcatcctgac
aatggatccaccacagctctaccagtctgtattaggggaacatgagcaaatggcatcgtg
tctgtgccagtcaccaagcactgaggggaagtctggaagttgccgcctgaacctgccct
ccagtcttgcaaatgctgagcaggagccaccagccttggactgtctgtgcttcttgctag
agcatgtgggtcattccagcctttccccagaacgtccattctctccacaccttcttcatt
ccaaatggggatccttgcctttcttttggactccagagacatgcataaaaccacaacaca
gctttagaaaacaaggcacacctgtattagtcttacacctaaattgaatgcagcctgcca
taaggaggaattacagtccttctagaggcccaaggtacctgcagctcccctgaccagt
cctgtcaaagccttgtttttgtcaaaatgccaccttggac >IGR3067a
ttcttttggactccagagacatgcataaaaccacaacacagctttagaaaacaaggcaca
cctgtattagtcttacacctaaattgaatgcagcctgccataagggaggaattacagtcc
ttctagaggcccaaggtacctgcagctcccctgaccagtcctgtcaaagccttgttttt
gtcaaaatgccaccttggactctgtctgagagttctgctgcccaccaagagggatggaca
aagtctgtttatccagaaacttggcaggaggtgcaggtgaagcagcctctgaacaaaagc
atattctgagatcctggtggctgttgtcagaggaacacagcagagagggcaaacagtttgg
ggtgaggcagctgataaacaaacagggaagcacattcaggccagagcaaggggaagcccc
tgagtctcctctatgtgctctctggcaagatctactttctgaagcattgactggaaatag
aagtctcgccgggctggctggagccagaggcccccacaccttatccccttgaatctgc
cagagggcaggtctgagtatggacttggatgatcaacttggttaatattcaggctatctt
gacagtctccacacccgtgagcaatgtcccagggcagcctgcaggcctgatagaaactcc
acaaacctgcctatcacggaaggttttccccttttgtcgg >IGR3068a
gagccagaggcccccacaccttatccccttttggaatctgccagagggcaggtctgagtat
ggacttggatgatcaacttggttaatattcaggctatcttgacagtctccacacccgtga
gcaatgtcccagggcagcctgcaggcctgatagaaactccacaaacctgcctatcacgga
aggttttccccttttgtcggggcctacccagaccccagggagggtgcatccttgagagcc
gctatgtgaagtcccacatagtggcagccgcatgtgagggttagtctgttctcattattcc
cttgcttgctgctctcagtgcctcccagaagttccccgttagcaggggaagaggccttat
ccttcgccacataacctggctcgcctctgggttatgggtggggaatcagtaagtcctact
gctgttcaggccctgacccagttcccaggaaagcacaaggctagtgccaccagaggtcc
aggccctttgctggaggctccatcaactccactaccagtgggctaccagcagctccacta
gggttcctagaggaggcagcccagctgcagaagaggacaggaggatctacggtgtggcag
cagccctgtcttagatcactggtgcctgcaaagaaggctggtccttaacacacaaggtt
cccccagggcctctggagcacaagacctggcagaagtggt >IGR3069a
catcaactccactaccagtgggctaccagcagctccactagggttcctagaggaggcagc
ccagctgcagaagaggacaggaggatctacggtgtggcagcagccctgtcttagatcact
ggtgcctgcaaagaaggctggtccttaacacacaaggttcccccagggcctctggagca
caagacctggcagaagtggtatccagcttagaggtgactgcctcagttttcccagcccat
ggactgatgggaaggtcaagaccctaatgatgctccatgggagaagaggacatgcttgag
gcaaaggccagcccatgcttagcccctggccacgagccaggattgcctgctgcttgcc
ctgtggccctgcagatgaacttaggccctctccagagcagagcatttgttgcccttcctg
ctcctttagcctcagggcaggaggctgccgggttcctcacacgcagggcctcttctctc
tgaggtcttggccctgagggctatatatgaagggccatgcccatggagactgagatctga
cccctgcagtaggtctcagggatgaggaccccagcatcagacactctgggttgcttgggg
cacttccttccccaacagaagcttcagtcccaacccaggtcccaccagtccctgcttgcg
ttcctgctcaactgctgcctgatggaaaacttagcaacga >IGR3070a
ctatatgaagggccatgcccatggagactgagatctgaccccctgcagtaggtctcagg
gatgaggaccccagcatcagacactctgggttgcttgggcacttccttccccaacagaa
gcttcagtcccaacccaggtcccaccagtccctgcttgcgttcctgctcaactgctgcct
gatggaaaacttagcaacgagctgtgactggcactcctcccgcaggggtaaacacagact
cctctagccctgactgcagagacagataaaggcccttaccctggatatctacattctcta
tccttaaagtgaaaaataacttggtttgagctagaataactggagcaacaaaataaagat
ggatagcattagtttataactgatgaaatataataagtatgtatgaacctgtactgatat
aagttaacaattgcatacattaataaatagatgtggagggggaagctcttcttctcagaag
aattccaattaataaatgttgaaggaatcagaaaatgcaaaatcatcactaggcaaactg
cagtaataattgtttcagtcaagacctagtgatgaatgctaaaatcagtgaataaaaatt
tgaggagacacaggattttgtataatctcgaagaacctcccttaagatatttattagtga
cagaggaaaaaatagtacctttacagcagagaaattccac >IGR3071a
gaaggaatcagaaaatgcaaaatcatcactaggcaaactgcagtaataattgtttcagtc
aagacctagtgatgaatgctaaaatcagtgaataaaaatttgaggagacacaggattttg
tataatctcgaagaacctcccttaagatatttattagtgacagaggaaaaaatagtacct
ttacagcagagaaattccacagacaccaacttgacaaatgatcaaggttaacatcaccag
taataagacacatcagcatcatgtacccactggtatgatgcccagagaatgcatcacttc
taaggtatcattaccaaaaagtgcataacgcaatctaattgtgagaaaaatcatgccaac
ccaaactgaggagcattcatcaaaatactcataaaaatgtcaagatcatgaaagataagg
aaagactaaggaacaatcacagattggagactgagacatgacaactaaatacaacatggg TABLE 5-continued attttggatgggatcctacgatagaaaaagggcagtagtagaaaaactggtgaaatccaa
acaaagtctgtagttcagttattactattgtaaccaatgttaatttcctggtttggataa
atgcataacgcgtatttaaattgttaacatcagagaaagctagatgaagggtatatgtga
aatctctgtactattttcaaacttctctctaaatcaaaag >IGR3072a
atagaaaaagggcagtagtagaaaaactggtgaaatccaaacaaagtctgtagttcagtt
attactattgtaaccaatgttaatttcctggtttggataaatgcataacgcgtatttaaa
ttgttaacatcagagaaagctagatgaagggtatatgtgaaatctctgtactattttcaa
acttctctctaaatcaaaagttatttcaaaataaagttaaaaaataatcgccaggcgcgg
tggctcacgcctgtaatcccaacactttgggaggccgaggcaggtggatcacttaggtc
aggagttcgagaccagcctggccaacatggtgaaaccctgtctctactaaaaatacaaaa
aacaaacaaacaaacaaacaaaaaactagccgggcatggtagcaggcccctgtaatccca
gctactcggaggctgaggcaggagaatcgcttgaaccaaggaggcagaggttgcagtga
gccgagatggcaccattgcactcctcaccctgggcaacaagaacgaagaaagaaactcc
atctcaaaaaaataaaataaaataaaataaaataaaataaaacgaaaaataatttgactc
ttagtaactgcacaggttgaaaaacttggacctcacaatcaacccctgaagaaggaaact
accttatacacatgtacacacacagacgaatgcactcacg >IGR3073a
ctcctccaccctgggcaacaagaacgaagaaagaaactccatctcaaaaaaataaaataa
aataaaataaaataaaataaaacgaaaaataatttgactcttagtaactgcacaggttga
aaaacttggacctcacaatcaacccctgaagaaggaaactaccttatacacatgtacaca
cacagacgaatgcactcacgcaaaccccaactcagacaccttattgctacctcctggcat
actatgaaaggcatttctacagcacagcatgccatccttggttcctggctaaccctgtcc
tcctgtgaagaggtgttggggggcagttcaggcagacttgtctgtcccaaagatatgcc
cattgggagatcctggcacggcagtataaggcaaagacacaatctgaggacagtcccact
acctgtgttgtgccaactgggatgcagagaaccttctcaggggccctgggcttggccctg
tacactggcactggccaagtcagtatgggttttggacttgtgttctattctctgaggcttg
gaactgccactgtggggagaggggctcagcctccagcaagtcccatcacctattacacag
gccacaacctggactttagaacagctcccaccatgcccactgtccccagccagtggagaa
ggcaaagaaggtgctgagcttctgcctttaccactcctca >IGR3074a
cagtatgggtttggacttgtgttctattctctgaggcttggaactgccactgtggggaga
ggggctcagcctccagcaagtcccatcacctattacacaggccacaacctggactttaga
acagctcccaccatgcccactgtccccagccagtggagaaggcaaagaaggtgctgagct
tctgcctttaccactcctcaccaccacctaggaagcccatttgctggtgccacactcttt
gctggtgccacactctgtgctggccaccaccggatggggcatggggcattatctcactga
gtcctcccaacaactcagataaggtggcttctcttattatcccattttgaaaactgaga
taaagtacacataatatacagtttaccatcttagccatttttaagtgtacagttcagaag
cgttcacactgttgtgcaatcaatctccaacactactttcatcttacaaaactgaaactc
tatacccatgaaacaacgactccctactccttccttcttccagtccctggcaaccaccat
ttactttctgcttctgtgagtgtgactactcctgtagtgaaatcagaaaataatttgtct
tgtgactggcttatttcactaagcgtagtctcctcaaggtttatccacgttgtagcatgt
ccttccttttttaaagctgaataatcgtccattgtacgcat >IGR3075a
tccctactccttccttcttccagtccctggcaaccaccatttactttctgcttctgtgag
tgtgactactcctgtagtgaaatcagaaaataatttgtcttgtgactggcttatttcact
aagcgtagtctcctcaaggtttatccacgttgtagcatgtccttccttttttaaagctgaa
taatcgtccattgtacgcatataccacattatgtttatccatttgtctgtggaaggacac
ttgggttgctttcaccttttgactattgtgaataatgctaccatagacatggtgtacaaa
tatctctttgaaaccctgttttcaattattttagacatatatccagaattagtattgctgg
atcatatggtgattctattttaattttttaggaccaccacattatttttccatagtgg
ctgcaccatttacactcccactaggaataacaagggtttcaatttctctacatcctca
ctaacacttgttattttctgtgtttaaaaacaacaacaacactttttagaggtggggtc
ttgccctgtcacccaggctggagtgcagagatatggtcatagctcactgcaacctcaaac
tcttgggctcaagtgatcctcctgccccagcctcctgagaagctggaactacagtcacat
gccctcatgcctggctaatttttatttattttttgtaga >IGR3076a
tgtttaaaaacaacaacaacactttttagaggtggggtcttgccctgtcacccaggctg
gagtgcagagatatggtcatagctcactgcaacctcaaactcttgggctcaagtgatcct
cctgccccagcctcctgagaagctggaactacagtcacatgccctcatgcctggctaatt
ttttatttattttttgtagagatgggtcttactatgttgcccagtgctgtcttgaactc
ctgcccctagcaatcctcctgcctcggcctcccaaagtggattctgggtgttttttt
ttcttttttgtagtaactattttaagggtacaaagtggtacctccttatgattttcattt
gcatttccctagtgattagtgatgttgagcctcttttcatcgcttgtaccccaatttat
agacaaggaaactgaggctttcatcagtgatgtaacctgcctggagtcagccaggtggtt
ggcagtggagtcaaaactggccctctactgagtctgactccagaactctgtgtgctgccg
ccccctctgggggagagccatccatccatcctgcttaccctggtacttgcttccttccctc
ctcctcccaaccaccagagcccagttttttgttgttgttgttgtttgtttgttttg
agacacagtctggctctgtcacccaggctggagtgctgtg >IGR3077a
ccctctactgagtctgactccagaactctgtgtgctgccgccccctctgggggagagccat
ccatccatcctgcttaccctggtacttgcttccttccctcctcctcccaaccaccagagc
ccagttttttgttgttgttgttgtttgtttgttttgagacacagtctggctctgtc TABLE 5-continued acccaggctggagtgctgtggtgtgatctcagctcactgcaacctccgcctcccaggttg
aagtgattctcctgccttagcctcccgagtagctgggactacaggggtgcaccaccactc
ccagctaattttgtattttagtagagacggggtttcaccatgttggccaggctggtct
caaactcctgacctcaagtaatctgcccgcctcagcctctcaaagtactgggattacagg
cgtgagccactgtgcccagcccctagttgcttttattttacttccaccactcaaaagg
aagccaggaagggaaaagctgccaaaaaaagcaaatcctggtgcatgtgtgtgaatgtgt
gatgatgtacatccttagaggtccctgtgaacagcgtacaacatgagtagctatggactt
ggaggccagcagctactcaccctcacgccctacagtgaacaaaaccagcgagcaatgga
aaagcagacaggtcagcccagctgccagggaaggctgcca >IGR3078a
gccaaaaaaagcaaatcctggtgcatgtgtgtgaatgtgtgatgatgtacatccttagag
gtccctgtgaacagcgtacaacatgagtagctatggacttggaggccagcagctactcac
ccctcacgccctacagtgaacaaaaccagcgagcaatggaaaagcagacaggtcagccca
gctgccagggaaggctgccactcatgggtccagcctccataacaggcactgataacactt
ccaggaatcgacgcgggatgagctggcccccagtctcagctgctcccaggccatgctgtg
ggcagggagtgggcaagcactagagccctgctagggaagcaaatccagagaagcatggc
caccttagggcccagggtaggtatggtgccaatgctgggggatcaaaggcagtccctgg
gctgagcccacttcccacaggtgccacagattcgacaaccaccacgcctggctggccacc
attctcttgcagaggagagttcaaaacttcctcactggtcttcttgtttatcatagcag
ctagagtgagctctttccaaaagcacgaacctggccttagaatgcttactattttctcac
tgtcctccgaataaagtcagctcctcagtatacatagaaggccactatgaactagcccctt
gtggccatttctagtctcatttgtcatatctgtcatccct >IGR3079a
ttcaaaacttcctcactggtcttcttgtttatcatagcagctagagtgagctctttccaa
aagcacgaacctggccttagaatgcttactattttctcactgtcctccgaataaagtcag
ctcctcagtatacatagaaggccactatgaactagcccttgtggccatttctagtctcat
ttgtcatatctgtcatcccttgagttccagccactccgatatatgagaattccattacct
gaatttcccatactcttgcctagacaggtcttgctcacattttcagaatcagctaaaatc
atatcaccccttcttggagtatttcctccacctattgtcccacagagagggtgatttatt
tatcccaggtcacatagcaagcaaggcaggacttgaatttgggttccagaacccctattgc
taaccagggttaatgttagccttctcagtaacacagccagtgtgccccatgggcatctga
gggtaggctccacacaccagatgtccacaccttagtgctcagcacaaggccagacacaat
gtctgatgaccgctataccgtgctgagggaaagggataagggactagcagaggccactca
ggttttttcttgggaggagcatgaggcagaggagggactagcagcagggaaatcctacctg
cctgaccaatagcaggcaacagctccatgaggatgctctc >IGR3080a
atgtccacaccttagtgctcagcacaaggccagacacaatgtctgatgaccgctataccg
tgctgagggaaagggataagggactagcagaggccactcaggttttttcttgggaggagca
tgaggcagaggagggactagcagcagggaaatcctacctgcctgaccaatagcaggcaac
agctccatgaggatgctctcctcagaagaaagtgtatcctgacccaggtccttaccaga
tgtgaagcagcaaaagcgggagaagtgtgtgtgcatcctcattcctggaacttagaaaac
ctgccactaaccacgcaggtgctgaggggctacagcccctgcctgccaactcaccctgt
gctcagagaggtccctgagggccagggcttccagctgggttcgccttctgtgcttcct
tgcacccaatgagcctcaggaggccatctgctgtcttagagaaactggggcctcaggaaa
ggaccccaaacctcacaagtatatggtacggcagtacacctcctgatgcctccagaagtc
tgtggccagggaacagacaagatttggccccgccctgcccagtaacaaggtccctcacac
ccctcctcccatgcctggcaggaaggtgactcaggcagtgcgtctgggtagcctgggctg
cgcttcccccaacgcaacatctaggttcttaggaaacttc >IGR3081a
atatggtacggcagtacacctcctgatgcctccagaagtctgtggccagggaacagacaa
gatttggccccgccctgcccagtaacaaggtccctcacacccctcctcccatgcctggca
ggaaggtgactcaggcagtgcgtctgggtagcctgggctgcgcttcccccaacgcaacat
ctaggttcttaggaaacttcatttgttgtgaaaatcggaaatgaaaagacagttggtgac
aaactccttctccatcacctccttattggacagaaacgaaccaggaatgcgcctcgcgt
gagtccctattctttcttggggtgcacacccgctgctggaagtatgaacagcaggtttgag
ggggaggggagcgctgacccgggcactgcgcaggagtctcaaggggggctgacgcagag
ggagggtcaggcactcccgggtcaacggtctcggcctggcacccacctcggtcacgacgg
tggacaggtagacgtcctggctgaactcccagccatccaggcagctctcctgctccagct
gccccaggtccacgtcgcgccccggctccagcccgagcgccgagaagttggcgatggtgg
cgagccggtagcggctgcagctgtggggcacctcgcggccgtcccgcagccgcagcggga
cactgttgttgcgccaggcgctgctcaggttcgcggcgtc >IGR3082a
ctgaactcccagccatccaggcagctctcctgctccagctgccccaggtccacgtcgcgc
cccggctccagcccgagcgccgagaagttggcgatggtggcgagccggtagcggctgcag
ctgtggggcacctcgcggccgtcccgcagccgcagcgggacactgttgttgcgccaggcg
ctgctcaggttcgcggcgtccggcactcgacaggcggtgctccgggtccccgccaggaac
acgactgacataccattgaagccattgggatgatgctggcgctgagcaggaagaagatg
aggcgctggaagggccccactcgcccaggaaggcgatcacctcgtcgtagtccccgcatg
cttcccactgccgctccgaaacttgcaactacgggtgatgacagcgttctcaggacagtg
tcttgtagctggggcgctccccaaggatgttagaacgttcccggggacaggcaggctgt
tagaaattggggcgcgaagccggggaccgttcctgggaaacaggctgaaggcgttggagc
gttcccgggagctcgcgctgagcttgatgccactgtacattgggaccacacccccatcc
ccggccgggcgcggggaagggagggcggcccagcccgggaggctgggctcccggctgtc
tccgccctgtgcttcgcgcgcccgcccgccccaaggacc

TABLE 5-continued

>IGR3083a
cggggaccgttcctgggaaacaggctgaaggcgttggagcgttcccgggagctcgcgctg
agcttgatgccactgtacacttgggaccacaccccatccccggccggccgcgggggaagg
ggagggcggcccagcccggggaggctgggctcccggctgtctccgccctgtgcttcgcgcg
cccgcccgcccccaaggacctgacggggcttccaggctgggctcagccattccgcccgc
gtgccggggaagaagctcgttctcggttgtccccagccaccccgagcgctgattcccag
acctgggccccacgtgggagggcgggcgcaagggaggagccgaggccagagagcgagttc
tcggaggggtcggccctcgatctgctcgggccgcgtggccccgggcccagacccccagcag
ggttccctccgcggtctcctccaatctggaggctgagcttaggctgccacgcgtggggcg
cggaggggcgagtcagtggagtcggttcccgggaaacttctgggggcggcagagcgacag
gagcgcgccctctcctgtggcgcctcgcgcaggcggctggcacacgccgacagggagctc
atttcccaacagtcctagcagagctgaattcggtcacccctggcggcgcccggacagcgt
cctcaggacagccaggaccctcatcttgcacagggaaaac >IGR3084a
gtcggttcccgggaaacttctgggggcggcagagcgacaggagcgcgccctctcctgtgg
cgcctcgcgcaggcggctggcacacgccgacagggagctcatttcccaacagtcctagca
gagctgaattcggtcacccctggcggcgcccggacagcgtcctcaggacagccaggaccc
tcatcttgcacagggaaaacaggcccacagcctggaagggatgagcaaggtcacactacg
tcagagatgggcccggatcggaggggagggcggggcaggagacaaccgagtgcccggga
ggcgagtttcctccccgcacgccggcgtaatggctgagcccagcctggaagcccccgcc
gggtccatgggcgggcgggcgccaggacatggagcctgcgcattgcgggagcacagtcat
ggaggcactgtcgtcacgctgggttctgattttgagcccttgctctcctcacgccccca
gggcccttatcgcggcaggctgtcagagctttctccgactggaaggctttctgttagca
gaagggcctgccccagtccaggaacagagggagggagggagagagaagtaggagatccg
atttggcgctcagacccggcagggtaaccaaagcagggaccacagcctccctttttttgg
ctcagtgcccagacctaaggcccttctgctgttgtgtgag >IGR3085a
ctgtcagagctttctccgactggaaggctttctgttagcagaagggcctgccccagtcc
aggaacagagggagggagggagagagaagtaggagatccgatttggcgctcagacccggc
agggtaaccaaagcagggaccacagcctccctttttttggctcagtgcccagacctaagg
cccttctgctgttgtgtgagctagcccgggcctggagcctgagccctgggggttcacgagg
cagataaaattgacaggtgaagagctcacctctttggagattttgcacgagtgtgtttg
tttcccaggctccgattaagaggcggagggacatttctgcctcttttttgtgtagcttcc
agtctgaccctcctcttaggaggacttcccacccccttgaacctcagtttcctacctg
taataagactatacatcctgatgtgctaggacagctctgatttatgcctattaatccagt
gaaattattaatagagcctcccttttactttcacaagtatccttcttcgaatgatatatta
tggtcattatcttacttagcttgggtttcatctccctactccaccccatataatagagca
aagttggagacaagaacgtatataaggtcgtttattctgagtaatgataccataaaacag
aagtgagggactaggaggagagtgaacagagagggaggt >IGR3086a
cctttactttcacaagtatccttcttcgaatgatatattatggtcattatcttacttagc
ttgggtttcatctccctactccaccccatataatagagcaaagttggagacaagaacgta
tataaggtcgtttattctgagtaatgataccataaaacagaagtgagggactaggaggaga
gagtgaacagagagggaggtaaagccaacatagactgtgaaattgagatggttattggcg
atgaccaagatcagtaacagtgttgtgtggagccctagtggagcctaagaataaatggaa
aattagcaatactgagcctgtctttattgaaaattttgatattgcgttcatcatgggtat
ttgcattaatttctatttaaaaaatattgcattaaaatataattaatcttggttactga
atttcttggtgcctccttaaatttgcaccagagacaagtgccttgctcttttttcctcacc
tcagcctgtctcaatcccattgctgtgggttactgaggtttaatcccactgggggctt
ctaaagagccatatagaatgaggaggtatttgtttcctagttctgtctctccattggtcaac
tgcttgcacttccagattagcacataagtgagggctgaacaggtaccactcgactatttg
ccattgctcacaagtgtatgtaaatctctatctggaattg >IGR3087a
attgctgtgggttactgaggtttaatcccactgggggcttctaaagagccatatagaatg
aggaggtatttgtttcctagttctgtctccattggtcaactgcttgcacttccagattag
cacataagtgagggctgaacaggtaccactcgactatttgccattgctcacaagtgtatg
taaatctctatctggaattgttttgtcctccatacaaaatgaatgaacaagtatactgct
tacagcttagcccactgggggaatttcccttcaaagttgtttagggctaccccctaaatg
gagctatgttacaggaacaatctcttttctttttttcttttttaactagtatcaatgtc
taaagctaatccatctgtgagtaagggctattttcccctccatcagttggttacagagaa
ctacctactaaggctgtaggtctgagctaagacagaagggttggtatagccgatagctga
ggtaggtgtcataggagtctgagccaccttttgttgacttacatgcacccctattgacctg
cttagtcctgatcctgaatttaccattcctgttctattattatatgatggattgctgata
agtctgctttttttttttttttttttttttgagagagattctcagtctgtcacccag
gctggagtgcagtggcacaatcacagctcactgcagcctc >IGR3088a
gagccaccttttgttgacttacatgcaccctattgacctgcttagtcctgatcctgaatt
taccattcctgttctattattatatgatggattgctgataagtctgctttttttttttt
ttttttttttttgagagagattctcagtctgtcacccaggctggagtgcagtggcacaa
tcacagctcactgcagcctcaacctccctaggctcaagcaatccttctacttcagcctcc
caggttgctgggactacaggcaaacacctccacacccagctaattttttttttctttattt
tttagagatggggttttgccatgttgcctcctgggctcaagtaattctctgccctcagct
tcctcccaaagtgccgggattacaggtgtgagccaccatgcctggcttaaacctgcctaa TABLE 5-continued tcttacgacttggtagactctgacaatacctggcttacaatgggtatctctggttgcata
gaccccttgatgtcccattgctaggctcttggttttattggggccaaacagctgcttttc
aaaagtcgaatatctctctgctgcatggccttgctccagaactttagagatctgtgctga
aactcttttattagggcatgtcagagactctgccctgtagccttattcatcatgtatgcc
tctagccccattgtatctgctggataatatgaaccaaatg >IGR3089a
taggctcttggttttattggggccaaacagctgcttttcaaaagtcgaatatctctctg
ctgcatggccttgctccagaactttagagatctgtgctgaaactcttttattagggcatg
tcagagactctgccctgtagccttattcatcatgtatgcctctagccccattgtatctgc
tggataatatgaaccaaatggtagagaagcttgtactctagttggacacactgtacagct
ctctcctgctctgggtttcacccgaaactgaaagccttcagggcacgaaatagatgggt
cagaggaatactccaccaagcactatgccttagtgttggaggatacagagctcaataact
tgtctttactttacaggggataaacctggcatgactactgatccctgataactttacccat
ttgtttcaaaataatatgggatagaagaagttggtggggatagatgaaataatatggg
ctgtgaatagtggttcaagggattcgttttactagtttgtctacttttacatccatttaa
cttattctagaacaaaaaagtaagaaaaaagttgaacaatatgaatgtcctgaatcttca
tattttatctgctatcctttggcatacatgtgtctttactaggacatctagagttcttg
cttcttcttgcttactaggtcaaattagcattaggtcatc >IGR3090a
gattcgttttactagtttgtctacttttacatccatttaacttattctagaacaaaaaag
taagaaaaaagttgaacaatatgaatgtcctgaatcttcatattttatctgctatcctt
tggcatacatgtgtctttactaggacatctagagttcttgcttcttcttgcttactaggt
caaattagcattaggtcatcaatacagttgactaccatgatgttcaatggaatattgaga
caatcaaagtcgctagatactgtgttgtgcagagaggagaactaacatagcccagaggca
agagagtgaatatgtactgctattattcctacataaaagcaaacagtttttcatcctcct
gactgaaggatattgagaagaaaatatttgatgttgaaattaatctctgcaataccaccc
aggatgtggttttacttctcatttaataaatcagtaagaaaggtgagggtaagtgtcagg
ggctttcatttggcccttcctaccttaatggctcttaataaaatagggagtaaatgttag
tgtactgccagttgctacaacatctgtcctagttatttacttagggataaggaaattagt
acagtgtggatcttcagacttctggatctgtttgcaagagtactccatttacctggcttt
catgagcctctgtcacgggggggaccatgatagtgtttccc >IGR3091a
taccttaatggctcttaataaaatagggagtaaatgttagtgtactgccagttgctacaa
catctgtcctagttatttacttagggataaggaaattagtacagtgtggatcttcagact
tctggatctgtttgcaagagtactccatttacctggctttcatgagcctctgtcacgggg
ggaccatgatagtgtttcccccccagcactgatgccagctcatactctgtacccaatagcc
tttgaaagtctggttctttttcttcccctgaccagagttactatgataaatggccacag
atctctcatgtggaaagattgggaaataattatcttgtaacctttggcagcattggag
ggctcttctataaaaaggcttggccttcttaaatcaataggctctgagcctgagaact
ggcctagatcaaggaaatttatgaggaaatactattttccattatggcagctgtcatctg
ccttctgctcatgagcccttgattttggggattgctgttgttacagtcaagtaatacaca
gtcatctgccaatttagttaactctagggacactatggtctattagccattgccatagat
agacccatgggtcaaagcacttagctgccacttggttttgtggtaattattattatta
ttattttagacggagtctcactctgttgcccaggttgga >IGR3092a
gattttggggattgctgttgttacagtcaagtaatacacagtcatctgccaatttagtta
actctagggacactatggtctattagccattgccatagatagacccatgggtcaaagca
cttagctgccacttggttttgtggtaattattattattattattttttagacggagtctc
actctgttgcccaggttggagtgcagtggtgcgatctcagctcactgcaagctccgcctc
ccaggttcacgccattctcctgcctcagcctcctgagtagctgggactacaggcacctgc
gaccatgtccggctaatttttttgtattttagtagagatgggggtttcaccgtgttagcca
ggatggtctcgatctcctgacctcgtgatccaaccgccttggcctcccaaagtgctggga
ttacaggcgtgagccaccgcgcctggccattttgtgataattttttatatctaccctgcct
ctgttgattgttacccatctggtctctgcaattccagggtcctaccatccccactgacac
taagaattcctcacctttacatgttgtgttgcctcggtgaaaagagtggcctctggactt
cccatgggaatgtagtcttctagtaggttctctgatcttgcataataactacaatctaac
atgctaatccctctgagacttctgactccttcagtattct >IGR3093a
ggtctctgcaattccagggtcctaccatccccactgacactaagaattcctcacctttac
atgttgtgttgcctcggtgaaaagagtggcctctggacttcccatgggaatgtagtcttc
tagtaggttctctgatcttgcataataactacaatctaacatgctaatccctctgagact
tctgactccttcagtattctgccaaggaagtttctggcatctctacttcatttccgaagg
tcgtaattgtgtccaagtttcaaagaagcatctcagaagcatgtgaaaatggttttatgt
atccttgattggatgttaatccctgaataatgagagtgccccagattgatacattctta
caaccctctcctcacaccccctgttatccctgttcctgccacaacataggtcccgtaattt
tttcaatgtgtatgctatttgcttataaatcagatactgtatttctcccacttaggctgtg
ctgagacctaacccctagttattggtctgcaggcaatgaagggaggtaggggatatggagg
agaataagcatcatcgttgggcccttgccttaggaggagtcttggcaggattccaggca
aggagaggcttgtctcctatagcaggagaaagatagctgcttctgctggccttgaaggtt
taggagaatccaggaattcaaaattctcacattaatctat >IGR3094a
ttggtctgcaggcaatgaagggaggtaggggatatggaggagaataagcatcatcgttgg
ggcccttgccttaggaggagtcttggcaggattccaggcaaggagaggcttgtctcctat TABLE 5-continued agcaggagaaagatagctgcttctgctggccttgaaggtttaggagaatccaggaattca
aaattctcacattaatctattcaaatgttcccattctttgttccagggttccatatgttt
cctatcagggccatgactccattgtagaaagtagagctatcacagctgtgaatcccttcc
ttgcaggtctgccttctaggaccactcttatgtcgactgtcttagcccagatttcctcct
gaaagcaaagcctgagtcaagagtttgtgtgtaggtgattttatttgggaatggatccaaa
ggaacaggaataagtgactggggagagtaaaacaggaaagaagggaagccaatataagag
tgcagaggccagatgtggtggctcacacctgtaatcctagcactttgggaggccgaggtg
ggtggatcatgaaatgaggagttcaagaccagcctggccaagatggtgaaacccnnctn
nctactaaaaatacaaaaattagccangcgtggtggcacacacctntaatcccagctact
ngggaggctgagncagnanaattgcttnaaccccnnggagg >IGR3095a
gctcacacctgtaatcctagcactttgggaggccgaggtgggtggatcatgaaatgagga
gttcaagaccagcctggccaagatggtgaaacccnnctnnctactaaaaatacaaaaat
tagccangcgtggtggcacacacctntaatcccagctactngggaggctgagncagnana
attgcttnaaccccnnggaggcagaggttgcaatgagccaagatcgcgccactgcactcca
gcctgggcgacagagcgagactccgtctcaaaaaaaaaaaaaaagtgcagagtctcaga
ccagcccgaagagctgcagccgccttttgcgccctcctgccttcccatcctccctgcc
gacatcatgctccagttcctgcttgaatttactttggcaatgtgattggaatgtatctgg
ctcagaactatgccacgccaaacctggataaaacacttgatgaaatgaaaaagggcaatg
ccgagaaaaccccctagttcatgaggccgactccagcactgccttctggatacactgat
tgcaccactcttgagggcctccttaccatctcaaccaaaggcttttgttttcatctcca
acctcagcgattttcgtcttggctagacccggtgctgccttaggacaaaaatagggccac
aagtaagaactacctatgtagtgtgacagatcccctgcc >IGR3096a
catgaggccgactccagcactgccttctggatacactgattgcaccactcttgagggcct
cctttaccatctcaaccaaaggcttttgttttcatctccaacctcagcgattttcgtctt
ggctagacccggtgctgccttaggacaaaaatagggccacaagtaagaactacctatgt
agtgtgacagatcccctgccaggttgtttaagggtacatgtccactgcctgaaccctgaa
ggccaggcaatgagccaaggccatggtgtatagctgaggaataggtgtccctgggaaccc
aaacatcctggagaatagctgagaacctaccaagggaaacagtcccatcacacacacata
gtaggtaaagagacagaaaattagcttagagatgggaggtggcacggatctctaaagctg
tcccgctgccattcaggagtgcctcatgcataagtcctaataaaactcatctactagccaa
gctgaacttgtcccagacatgcttggtctctttgctccctcccagtttggggtaaggttt
ttttttaaatacaattccaggtttttctcattacaattgctgtcatgagcaggatctgaga
aaccaatggatgaattaggaaggcgcatctgcggggagaatcctagggtggttggcaaca
tgcatgtggcgtggagttgcccgactgctcaatcttcaca >IGR3097a
gcttggtctctttgctccctcccagtttggggtaaggttttttttaaatacaattccagg
tttttctcattacaattgctgtcatgagcaggatctgagaaaccaatggatgaattagga
aggcgcatctgcggggagaatcctagggtggttggcaacatgcatgtggcgtggagttgc
ccgactgctcaatcttcacaggccaccgtggactctgggaaaacactggcagaaactgaa
tcacctattgtaagaagttaagatattaaaatacgataaagataataaatgtgctattgt
tgcaataagggtagctactgagaaatcatgagagcaggaaaggagaaagggtaaaaact
cctgcagaaggtgaaaggcatgccaggttttctaggacaccagcaggttacatatgatgg
cctattcttgtgcacgttctaaaactgatgggcaaataacaacaacaacaaaaaaaaaga
gctcaaatggttaagctgcaactatagagttaaatagcatcttcatatgctctctgtttc
tctctttcttttcccacatgctttgaatctgctgttattaagccaccgtgttgagataaa
actcactgtttatggtaacactaattcaaggttatttggagattttgttttttcttataca
attaagccagttctagttaaaatgtaaacaataaaatgaa >IGR3098a
actatagagttaaatagcatcttcatatgctctctgtttctctctttcttttcccacatg
ctttgaatctgctgttattaagccaccgtgttgagataaaactcactgtttatggtaaca
ctaattcaaggttatttggagattttgttttttcttatacaattaagccagttctagttaa
aatgtaaacaataaaatgaaaacgaaaaggaaaaaagaggtttttaaaaatcaaactgcc
atggaaacttctttcccccaaattttgatccacagctttccttggattacctatcaggga
aaatagagcttagccataacaggtcccaatttttgtcaaaagtaatttgggtccaactgtc
ttttgtaaaaacaacaaaatttattatattgtctcatggctagagttctgaagtaaaatta
tcagatcttttgtgtatgtatgtatatacatgtttaaatatattatatatgtgcatgtatt
atatgttctaacatgctaccaaataaaattatagataaatgggtataaagtccaaatgct
tttcaagttcacaggaattcaataatctttgctaaataagttggcttttaaattattagt
aaataaaaataaagatatcttcaaaagtgtcagcatacatttttgtctgagtcttctgat
aaaatacactttatatttgcctctgctagatactttaaag >IGR3099a
aaataaaattatagataaatgggtataaagtccaaatgcttttcaagttcacaggaattc
aataatctttgctaaataagttggcttttaaattattagtaaataaaaataaagatatct
tcaaaagtgtcagcatacatttttgtctgagtcttctgataaaatacactttatatttgc
ctctgctagatactttaaagggtcagggtttacatgaaagttagaagactgtaaaccca
gccaaaaataaaatgatctttgtctgtatgatttttttgataagcaagactaattcgata
ttgttggtttaatgaaaacaactgaatttctgagttatcagcaggaatcccatgtgtt
taactttaaggctcttgcttagatgaacctgatattcacaagctatgaaaatggttaa
cagggaaataacttgcaatgacgattagctttgttgactgtcttggttctcacaagtaat
ctagataaactgctaaaaatgaataaactgagtacatgtaaatgagataaatgtgtgtag TABLE 5-continued gtgaaaattctgtatagtttaaaatcttaaaattactttaggtactcattgaatgtctag
gtcatttccagtttaaaagggttatgatatgggcgaggtatttgtggaccttaatgagc
tagataaaaacaaggactgggccgggcgcggtggctcacg >IGR3100a
gaataaactgagtacatgtaaatgagataaatgtgtgtaggtgaaaattctgtatagttt
aaaatcttaaaattactttaggtactcattgaatgtctaggtcatttccagtttaaaag
ggttatgatatgggcgaggtatttgtggaccttaatgagctagataaaaacaaggactgg
gccgggcgcggtggctcacgcctgtaatcccagcactttgggaggccgaggcaggcggat
cacgaggtcaagagatccagaccatcctggccaacatggtgaaccccgtctctactaat
aatacaaaaattagctggacgtggtggcgcgtgcctgtagtcccagctactcaggagct
gaggcaagaaaagctcttgaacttgggaggcagaggttgcagtgagccgaaatcatgcca
ctgcactccagcctggcgacagagtgagactctgttgcaaaacgaggaccaagtccagga
aataatcaaagaacaaaaaggggatgagccaattgaatgtacacttgccctggtataggc
aggcaattaacacgaaaaaataccacctgccaggggatgctttgaaatcacctgaacaa
tccaggaattacataaggcacaaatagtccagagcacctataacagccctatgtggcctg
caaagaagccatatgatacctagaaaatgacagtaaactg >IGR3101a
gggatgagccaattgaatgtacacttgccctggtataggcaggcaattaacacgaaaaaa
taccacctgccaggggatgctttgaaatcacctgaacaatccaggaattacataaggca
caaatagtccagagcacctataacagccctatgtggcctgcaaagaagccatatgatacc
tagaaaatgacagtaaactgccgtgagctaaacagagtgatgcccccgtacctgcagct
gtacccggtattgctcagctgctagagcaaatggtccttaagctgggaaatgtccatgct
gtgattaatttggctaatgcctttaaagtattcttagcagacgattcacaggagcag
tttgcattcatttggggagggcaaacaatggattttccaggtgctaccacaagaatatctg
tgcagcccaccgtctttcatgatatgattgcacaggacctgtctagattcttgcctacc
tcagtcttcctgttttaccatactgataatataatgttaacctcagaatctcttacaaat
ctggagactgccctgcacaccatcttagacagcctaaaaaggacagggaatgggaagtca
accccaaaacatacaagggcccagtgtagccatcaaattcctaggaattacctggatgg
gtaagacacgaaacatacccagagctgttattgataagat >IGR3102a
tactgataatataatgttaacctcagaatctcttacaaatctggagactgccctgcacac
catcttagacagcctaaaaaggacagggaatgggaagtcaaccccaaaacatacaaggg
cccagtgtagccatcaaattcctaggaattacctggatgggtaagacacgaaacatacc
agagctgttattgataagatagcacagtagcctattcctcagacaataaagcaacttcac
gttttcctaggtttattaggctactgaaaatattcatctctcatttgacacaaaccctc
tggccttcacacaccctagtaaaaagggatgcaaaatgggactggacacataaagagcaa
gaggcatttgacaaagcaaaaatgttggtaaaacaagcccaagcattaggtgccccacag
ccacagcacccttttgcattagaagtcactagagataccgcagggatgaaatggtgtttg
tggcaaaagcaaccaacagtaatggtacttgtaagatttggtctcaattatggaaggggg
cataatcccactatatagtcctggagcaataactctggctgtatataggcattgcaaca
aatgcaggccatcaccagaaagcaaaccatcacaataaaaacttcctctcctataaaagg
ggagatggagggccttctagccaagcccatctctgggatg >IGR3103a
aatggtacttgtaagatttggtctcaattatggaaggggcataatcccactatatagtc
ctggagcaataactctggctgtatataggcattgcaacaaatggaggccatcaccagaa
agcaaaccatcacaataaaaacttcctctcctataaaagggagatggagggccttctag
ccaagcccatctctgggatgatacaatcacacactgctgaagtggcatgcctatctacaa
cagaaggtgtcttgtccatgagtcctgtaagtcaggcaccacagaaatgctcagaccca
tccactttgaacaagtggaaggggccgacatggcaatgaatctacctactaggccaacca
tcatatatgaagggattccattgatacccactagggcctaataacctgatgggtctagca
aaggcacccaacaccaatggttggcaatcatggtgaatatggacactgacaacatatggt
tagaatgggaattaggacaaagcagtcaatgggccatgctacaggcagtttggatactca
tcacccacaagccctggccattagtcatttgcacagataattggactacatacagaggcc
ttaccatgtggatcaatcagagtgccacagacaattggcaagtttggggcaggatcctct
ggggaatgaccatgtggcaagacatccacatcaggttaca >IGR3104a
agcagtcaatgggccatgctacaggcagtttggatactcatcacccacaagccctggcca
ttagtcatttgcacagataattggactacatacagaggccttaccatgtggatcaatcag
agtgccacagacaattggcaagtttggggcaggatcctctggggaatgaccatgtggcaa
gacatccacatcaggttacaggaaagggatgtccatcttgtgatgtaccatatggatgca
catagcccaaacaaccttctggaaatcaaaaggcgaatggccttactcattcacgtgcag
gcaatttgcccaagccatccgaggaaatgccgtatgtgcacatcataaaaacggccacc
aggggcaatcacagagtggcccatagcaaaagcagcaggcatccctatccaataagcaaa
tgttttggcagctgttcagaaccatgagatctgctcacaactgtgacctagaaagattcc
ctccacaccaggtcacatacattgagccatacaaactatgtgagcctggcaagtcaattg
tattggtcccctgccccagaatagaaagaaaaggtatgccttaacttgtatggacacaac
ggggctgctacaggccttcccaataaaatgtgccactcaactggagatcatcaaatgtct
cactgctcttttgtgtgtgtgtgtgagacagaatcttg >IGR3105a
attgagccatacaaactatgtgagcctggcaagtcaattgtattggtcccctgccccaga
atagaaagaaaaggtatgccttaacttgtatggacacaacggggctgctacaggccttcc
caataaaatgtgccactcaactggagatcatcaaatgtctcactgctcttttgtgtgtgt
gtgtgtgagacagaatcttgctctgtcccccaggctggggtgcagtggtgcgatcttggc TABLE 5-continued tcactgcaacctccgcctctcaagtagctgggatcacaggtgccccctgtaatacaaaa
acgcctggctaattttttatattttaggagagatgggttttcaccatgttggccaggttg
gtctcgaactcctgacctcaagtgatccacccacctcagcctcccaaagtgctgggatta
caagcgtgagctaccatgcctggacctcactgctcttaacgtcatgtatggcataccaaa
aaggatagataatgatcaaggccccaattcacaggccataatattaaacactgggcatca
gaacaaaacatagactgaaagttccacttaccatataacccaacaggggcaggccttaca
tgcattgtcttaggactggactaagaatctccctgtaatacaaatttaaatgtcaccca
ctaccatgcatggcatcacttcctgtgaatggttggcaag >IGR3106a
gccccaattcacaggccataatattaaacactgggcatcagaacaaaacatagactgaaa
gttccacttaccatataacccaacaggggcaggccttacatgcattgtcttaggactgga
ctaagaatctccctgtaatacaaatttaaatgtcaccactaccatgcatggcatcact
tcctgtgaatggttggcaaggtttgtaaaccaggccccacaaactcttgggttacctct
gagactcagatccatgatcctgaaacaaatggccagactttgcccctgagcacatcagtg
gatctaccaagtggcgatggctacatggacccaaagttgagctggaaaatgcccccatac
tagatcgattttatagcgctggaggacaccatgaagactgactgaggggaaatggtccca
gccgtgctccctgatggagatccgagatactgacgttatcaatgcagcaacaccaaca
cctgctagatgcgttaaatgtggatagcacaggcaaggccagaaatttaccaattggctt
tatgcccaccoctgtggagggaaaccctatatagtactgtaagccaggctcgaggcccag
ggcatctgccctaataggccaatgggaaaatgattatgttagcaataattaagttaca
aggaatagatataccatgagggtttctactaaacgcctg >IGR3107a
tggatagcacaggcaaggccagaaatttaccaattggctttatgcccaccoctgtggagg
gaaaccctatatagtactgtaagccaggctcgaggcccagggcatctgccctaatagggc
caatgggaaaatgattatgttagcaataattaagttacaaggaatagatataccatga
gggtttctactaaacgcctgtgtttatgcccaaaggccatggcttctgctacccatggta
gntagtaatgtcttcctggactgggctgcagctgcagcaacagtcaacaaccagccctgt
tactgggtatagggatacctcccccctgtcaaatgataatggcatgccttggaatattctg
cctttctcccaacagaactggaatgattgcttcaacagcatcaataaggcaatccggctc
actgggactgcctccacctggaggccaaattgccaacatgacagagaccaaacaacata
cgtcctcataggcactacctgttatttctctgataaagagaatcatgtcacagatgcttt
aaatcatttgtcaactcagatccatgatatagttcaattaggttactttgactcattctt
aaattaggtacacagcttacctacttgctggaattatgttttgctaataggcatcataat
tataganagcttctgcttttatgctcttatgtataccat >IGR3108a
gttatttctctgataaagagaatcatgtcacagatgctttaaatcatttgtcaactcaga
tccatgatatagttcaattaggttactttgactcattcttaaattaggtacacagcttac
ctacttgctggaattatgttttgctaataggcatcataattatagaagcttctgctttt
tatgctcttatgtataccatgaagtggcctgtatccacaaactgtggntatacattata
gacctctatagctcttcccctcgtttcctgctcagggactctcgagcaaggttggtggaa
agaatataagagctggggaatgggatgaattgaagtatgacaggttccccggccaggtga
ctcaaggtgtatgtccgctgcctgaactctgaagatcaggtgatgacccaaggccatgg
tacccagccaaggagcaaatgaccctgaggacccaaacatcccagagaatagctgagaac
ctaccaagggaaagagtcccatcacacacacagaagaagcaaagagccagaaaattagct
taaaagcagcttagggatggggggtggcacagatctctaaagctgtcccactgccatcca
ggaatgccttgtgtgtaagtcctcataaactcatttgcttaccaagctggacttgtctga
ggcactctttggtctcttggctccctctcaatttgggaga >IGR3109a
atcacacacacagaagaagcaaagagccagaaaattagcttaaaagcagcttagggatgg
gaggtggcacagatctctaaagctgtcccactgccatccaggaatgccttgtgtgtaagt
cctcataaactcatttgcttaccaagctggacttgtctgaggcactctttggtctcttgg
ctccctctcaatttgggagaaggtatttttttttaatacaattttgggttttttcttgttac
attacccttatatttccgacatccttatctctttccacatcttccttcagccgtttggg
aggttctaagactggaattacggtgctagattagtgaacatgaccttaatgagtagtct
ttcccttattctttgggattttgactacctttttgtcagatgaaaaattggtgagttttgt
gtagctgattggatgcaaataatgctgatttcacattttagcaaagatgcttgttaaaca
tttggtacgaaattgtgttgtttctaagtaattaaaatctatttagaagccaaagaagaa
gaagaggaagaggaaagaagaagaagaggaagaggaagaagaagaagaagaagaagaaga
agaagaagaagaagaagaagaagaagaaaagaagaagaagaagaagaagaggaagaagaa
gaagaatgcagcagtaggttgtttacagatgtaagaaatt >IGR3110a
tttctaagtaattaaaatctatttagaagccaaagaagaagaagaggaagaggaaagaag
aagaagaggaagaggaagaagaagaagaagaagaagaagaagaagaagaagaagaagaag
aagaagaaaagaagaagaagaagaagaagaagaggaagaagaagaagaatgcagcagtaggtt
gtttacagatgtaagaaatttgggtatgggtctcagaaatgtccatcttttaaggttcaga
agtagggaatatttaggtctgggctggagatacctattggggtggtcataactgcaga
gttcctgaggcccttgttgtgacagcagagccagccagggttcctggttgcaagcatgct
cacagaattgatgggaaagctgaggtactgctgagataagcagaaatcagctgttggaga
tggcacccgcctgggaagtagacagaccagagtggagccctaacagggcagcctgcttca
gactgagcctgaaggggaggagtggctccttgactgggccaggtggcctctgatcactgt
cctcccagaacaagtccagtgtggctggagtaagagcacaaaaggagggtagggacagtt
tagaaggggatgtggttattagacagcgcaaacagcacaaacaaccctagacaatgagcat
ctggggaggaatggaggagctaggacagggccttgaggag TABLE 5-continued >IGR3111a
agtggctccttgactgggccaggtggcctctgatcactgtcctcccagaacaagtccagt
gtggctggagtaagagcacaaaaggagggtagggacagtttagaagggatgtggttatta
gacagcgcaaacagcacaaacaaccctagacaatgagcatctgggaggaatggaggagc
taggacagggccttgaggagtggtgcctcaggggcaggcaagagagtggacaggaacact
ggctgggaaggcacaggdtgacaggactgaggagaaagagacttcttccacccagaaatc
tctttctgggtggtgagacagtctccagcaattggagagagagccctgggggctgggaag
gggccagtccaggctgtctctcagcaggctcctggaaccacggagggtcagtgagtggtg
gggatgacccatttagccgggatcatgaccagacgagtgagtcaagcaggcatggtggta
ggttcatgcatatcagagttggtgatcaggtgctgtggcaccagccttgtccacactcag
atccaaagcttcaggggtcacctttactttgcccagcttccaccattccatgccccatgc
aaaaagttggtaaggttgagcctgcactctgggctgttctggggaccttgccaagtggaa
acagatcagcacccttcagaaatggcttggtcagagtcac >IGR3112a
ggtgatcaggtgctgtggcaccagccttgtccacactcagatccaaagcttcaggggtca
cctttactttgcccagcttccaccattccatgccccatgcaaaaagttggtaaggttgag
cctgcactctgggctgttctggggaccttgccaagtggaaacagatcagcacccttcaga
aatggcttggtcagagtcactaaaccattggtaggcaggcaacactctccatggaagact
ggtatgcgccgttactttggttgccctgccatggagatttgctagggtgtgtgtgacct
tggcaagttttttaacctttctgagctcatccataaaatgggataataaccatacttcc
tttctggttggtatgaggattaaaaacaatcatatcgttcactaagggcttggagatgaa
ggcctgggacacattagctcccataatagttattatccaactcccttcccttcttctgag
actgtgggtgtgctccagcttcccatgaaaattcaattacagaccaagaacaccctggat
ggcagctgagtgttcttgcactgcagccattgtcagtgaagctggtgtgtgtgtgcgtgt
gtgtgtgtgtgtgtgcgcgcgcgcgcgtgggtgtcggggtggtgcatcagcctct
gagcttggctcaccgggcctgacagacccacttaagggct >IGR3113a
tcccatgaaaattcaattacagaccaagaacaccctggatggcagctgagtgttcttgca
ctgcagccattgtcagtgaagctggtgtgtgtgtgcgtgtgtgtgtgtgtgtgcgc
gcgcgcgcgtgggtgtcggggtggtgcatcagcctctgagcttggctcaccgggcct
gacagacccacttaagggctggttaatgcggtttctgagcccacatggctgagaccgact
ccagaccctgcaggacccagtgaggtctctagcagtctctcctgggatttctagtctctg
cattccagccacaaatggatgtatgtcagacactagcaaagttgagggttggtttctgta
gggaccctaatagtttcccacttgtggtagaggggacacaggaggacagtgcttgcttat
tagagaaacctcttcactacccttaaacctttttagaggttccacctccattcagatgtg
ctgtgggaatgttgttagaaagacagattattctgtgagaaaatgataaaccaggaagtt
acatgaaaagcaagtcaggggtcggcctggggtgcaagacaagaagttgggtaagaatga
gttgtccaggatagcactggagtgcacgtagctggacaggggcacccagaggtggagggg
aggtggggcactccccaggtggggcagagggactcagggc >IGR3114a
agacagattattctgtgagaaaatgataaaccaggaagttacatgaaaagcaagtcaggg
gtcggcctggggtgcaagacaagaagttgggtaagaatgagttgtccaggatagcactgg
agtgcacgtagctggacaggggcacccagaggtggagggaggtggggcactccccagt
ggggcagagggactcagggcccacagcccaggcttctgggcatcatggtgtggtgcaagt
cacaacactgctcccacccatccaactcagcagttcaagggctgtgagcccagggccaag
ctagcacacccctagaggggctgagtccttggccatgaagggagggctggcttgaagct
gcatctgggctccgcctaccttcaccccttttctttggttctctaggaggaaagtatcaaa
taacaaagcttgtcactcagagaaccagaaaggactccatttgtgtttcaacctccttgg
agggtcaaggaagcctgcaagagtcttgaggagagtttgatggggctgaacttacagata
agcacaatgagagttacagaggcacaagttgtccacagaggccagcaggggctgtgtacc
tcatgtggccctgtgagctgggatttggaatttagactctgtcctaagagcagtgaggag
ccatggaaactataataggcaagattgacagggaattgca >IGR3115a
gagtcttgaggagagtttgatggggctgaacttacagataagcacaatgagagttacaga
ggcacaagttgtccacagaggccagcaggggctgtgtacctcatgtggccctgtgagctg
ggatttggaatttagactctgtcctaagagcagtgaggagccatggaaactataataggc
aagattgacagggaattgcacttgaaaaacctcctttagctgttatgtagagaaaggatt
gagggaggggccaggcaggagacagggagacaaggcagggcccttacactgttcagcat
gagacagttggcgtctggactggggagagtgggctagtttggaattagttagggatgaacg
cagtcatgcttgctaactggttttactgcgtctacctttgccccttagggcctattctcc
atacagcagacaatgtgatcctagttaaaacataattccaggtcatgccgctcctctggc
ttttcatctcagagtaaaagtcaaagtccttaccatggctgtaggagaacctgttgc
gtggcaagaatgatgcttttttttttttttttaacagggtctcactctgttgcctaggct
cgagtgcagtggcaagatcatagctcactgcagcctcgaactcctgggctcaaggggtcc
tcccacctcagccttctgagtagtttggactataggtgca >IGR3116a
tcaaagtccttaccatggctgtaggagaacagcctgttgcgtggcaagaatgatgctttt
ttttttttttttaacagggtctcactctgttgcctaggctcgagtgcagtggcaagatca
tagctcactgcagcctcgaactcctgggctcaaggggtcctcccacctcagccttctgag
tagtttggactataggtgcatgccgccacagctgctatttttttttcattttttattt
ttctagaggggggtctcgctatgttcccaggttagtctcaaactcctggccttgaaag
atcctcccgccttggcctcccaaagtgctgggattacaggtgtgggccactgttccaggc
cacttgatccaaaaccaccgtaatgaccaatgtttgaccccctagatgccaagatattcat
cagcaagatcttttaaacaatgcctgtagaatagaaaactcttcataaagatgcttattta TABLE 5-continued acctctccagtggtcacgagtcttggcaagaaagtctgaagacgggaccagctgcacatg
ttttaccctaagagcttgctatataaaggatactttctggaaggctggttggtgtgagga
ttcagtcttgcagccactcgagacatcacttctgttcgtaagtcccctcttatatatttct
ctctgagaaaatggatttgtcaacctctttctttggcttc >IGR3117a
tcttggcaagaaagtctgaagacgggaccagctgcacatgttttaccctaagagcttgct
atataaaggatactttctggaaggctggttggtgtgaggattcagtcttgcagccactcg
agacatcacttctgttcgtaagtcccctcttatatatttctctctgagaaaatggatttgt
caacctctttctttggcttctcagctctctcggcctttgggtttgcatagtcctgctatc
catgaacaatggctcacaagggccaacacagccttgtctccctcacatctctctgacga
cctcatctactacttccagccacctcacttatactacttcagtcactgcttgcctagggc
cttaggatttcctgtgccctctgcctggaatgtaatcccccagatacctgcacagatga
tatcttaccacctcagttctctgcccaaatgttaccttatctgtgaggccttttccagatt
ccatatatgaagagaatcccttatgctctactgtaatgccttctttatttccttgatagc
actgcttatagcctgtagttattttacatgttcgttcaaaatgttttcctagggtgcaac
acaatgcctggcatacagaaggttcttaataggtattttttgttttttgagacagagtctt
gctctgtcacccacgctggagtgcagtggcgtgatcttgg >IGR3118a
ttatgctctactgtaatgccttctttatttccttgatagcactgcttatagcctgtagtt
attttacatgttcgttcaaaatgttttcctagggtgcaacacaatgcctggcatacagaa
ggttcttaataggtattttgttttttgagacagagtcttgctctgtcacccacgctgga
gtgcagtggcgtgatcttggctcactgcaacctccacgtcctgggttcaagcaagtctcc
tgcctcagcctcctgagcagctgggactacaggtgattgccaccacacncgggataattt
ttgtattttagcagagacggggttttgccatgttggccagactggtcttgaactcctgg
cctcaagtgatcccccccaccttggcctcccaaagtgctgggattacaggcgtgagccac
tgtgcatgaccttttaataaatatttagttgactgagtgagttgaggttgaggatgcagg
agggagcaggtgccctccaggacagcagtccccaacctttcgggcaccaggggactggttt
tgtgaaagacaacttttccatggatggagggcagggatggtttcaggatgattcaaacac
attacacttattgtgcactttattcctattattattacattgtaatatataatgaaataa
ttacatgactcaccataatgtatggtgaaggaagccctga >IGR3119a
gacagcagtccccaaccttttcggcaccagggactggttttgtgaaagacaacttttcca
tggatggagggcagggatggtttcaggatgattcaaacacattacacttattgtgcactt
tattcctattattattacattgtaatatataatgaaataattacatgactcaccataatg
tatggtgaaggaagccctgagcttgttttcctgcaactagatggtcccatctgggggtga
tgggagacagtgacagatcatcagacgttagattctcataaggaatgtacagcctagatc
ccttgcttgcacagctcacaataggggttcatactcctggaatcctagaatcctagaatcc
ctactcctagaatcctagaattagagaatctaatgccactgttgatctgacaggagatgg
agctcaggtggtaatgcaagcaatagtgagcggctgtaaatacagatgaagcttcactcg
cttgcaagccactcacctcctgctgtgcaacccaatttctagcaggccatggtctatggc
ctgggggattgaagacccctgctccaagacttacctcccactgagaactcaggcaggatgc
ttggaggtgaggtgaaaggtagtgggaggaagggaagcccagtgtatgtgtgagtgggtg
tgtgtgcttgtgtgcctgagtgagggtgggtgcttctcca >IGR3120a
tgctgtgcaacccaatttctagcaggccatggtctatggcctgggggattgaagacccctg
ctccaagacttacctcccactgagaactcaggcaggatgcttggaggtgaggtgaaaggt
agtgggaggaagggaagcccagtgtatgtgtgagtgggtgtgtgtgcttgtgtgcctgag
tgagggtgggtgcttctccaggacccctgtacctcccagttcctggcctgggtgaggct
gggcaggacagaggtaaatctgagccaggtgtctgaccaaggagataacaggttgtgccag
aggcaccaggcaaaactggaagggatgggatggagggcatgtggatggaaactattaact
ctccctggggatgggagggccgaggctttgctctaggggaggggcagtagagttgggcc
ttgaagagtgagtaggagtttgctgagccatgacaaaagaagaaaggcattttgagcttc
agaggtctgagggctatgaaaggtggactagctcagaggatgctggactggactgtctg
ctgtagcagagaggtgagacaaagtagtcagcagcccgaggtcagagaggctttaaatg
ctagtgggaggaccagggactccatcctgagggccccgaggtcagagaggctttaaaacg
ctaggcagaggaccaggaactccatcctgagggccctgag >IGR3121a
aaggtggactagctcagaggatgctggactggactgtctgctgtagcagagaggtgaga
caaagtagtcagcagcccgaggtcagagaggctttaaatgctagtgggaggaccagggac
tccatcctgagggccccgaggtcagagaggctttaaaacgctaggcagaggaccaggaac
tccatcctgagggccctggaggtcagggagactttaaatgttaggaggaggaccagggact
ccatcctgagggccctggaagagttgaagcaaaggaatgagagattccttcagctgccct
gaaatgggtctaaaaatgcttgggaggcaaaatcctagcacagtgctgggtaggatgtt
atggctggcatgagggtgtagaggatgatatccatgtctttggtctgaaagcccctgagg
taaggaactgggccctgggttcgagggatgtagcaggtttggggacaacagtgaaagtt
ggttctagccaggtaggctggagcctggacactgtgaattgggatcctggatctggttt
cccccctcctggagagagactctgatgtcccctgtctcagtactgggaccctgggccatac
aaaccttgtcctatgaggaccctgtcccaagcttttcatggtcgactacactcagggccc
ctgggcagacgaggtgggctggggactgggtagaggctg >IGR3122a
gagcctggagcactgtgaattgggatcctggatctggttccccctcctggagagagact
ctgatgtcccctgtctcagtactgggaccctgggccatacaaaccttgtcctatgaggac
cctgtcccaagcttttcatggtcgactacactcagggcccctgggcagacgaggtgggct TABLE 5-continued gggggactgggtagaggctgggccttgaagctggggaaaggacaaatcaggctgtcagct
ctgaatgccactcccttagctgccctccaagccaccccaaccaggatgcccaggcagg
ggctgctgtagttgctgcaaccctgaaggggtggagctgttgatctcggggtagcctatg
gtggcagggagcctcttgggtggtagtttctgttgggggaaggggttattgcatgtcatg
ggattaaggtgagtaccagcagctagtggatctgtggtggccagtgggagagtcgagttt
ctgcgggtgagtgggagtgagaggtgggggccagggcccatggctcccggtattttcca
cccactcctgtgcttaataatgcttccctgctttcctgggtgccagtcatcctctcctct
cccacctatgactgggtgggctgggaccaagtcagcggaggcagggtgggcaggcaagg
gcagactcctccaccaccccaccctatttgggtgtggctg >IGR3123a
gaggtgggggccagggcccatggctcccggtattttccacccactcctgtgcttaataa
tgcttccctgctttcctgggtgccagtcatcctctcctctcccacctatgactgggtggg
ctgggaccaagtcagcggaggcagggtgggcaggcaagggcagactcctccaccacccc
accctatttgggtgtggctgcagggagcgtgtgtgcgtgcacacctgcgcagcgctacgg
tggggcgccctcagggcctcaacgcacacagtctgaccccttgggaagcaaaaggagaca
agggccagacatgatctgggtcaccagcaggaccaggacgccaccttgcctcactgctc
tatcagcacctgccattgccctgaactgtgctccttcagggaagggaggaggcaaaagg
agccttaagagggaatctctagcacaaatttaaccatgaacagaagatctatgagaagaa
aggaaaataaaaacttaagcgaagacagacacaacatctgaataaatgcacaggaagtgc
agatcacagtcctctctggaggaaaagactaatgccagttcttcccaagtgagtccctag
attcagggcaacctggtcacagttcagaggtttgcttttccagagcctgaggcatgcagt
ctcaacttctgacaactggaaatgtagaggaatagctttg >IGR3124a
gaagacagacacaacatctgaataaatgcacaggaagtgcagatcacagtcctctctgga
ggaaaagactaatgccagttcttcccaagtgagtccctagattcagggcaacctggtcac
agttcagaggtttgcttttccagagcctgaggcatgcagtctcaacttctgacaactgga
aatgtagaggaatagctttgacaggtttgtaaatgaccaacaaggagggagagattggcta
ttaaactccaacacagtagtaattatacattaacagggaaatagatcagatgaccagaat
ccagtaacaaagattcgtacaaaattaggaaaagttcctaccaatcattaagaagaagtt
aaataagccttggaaaaaaatcatgaagggtttggggtaacttacacaagaactgctctt
ttgagagtgaggaccactctgttcccttagtgctaggcacccagcaaacacaccataaat
gctcaaaaactgaatgttcatcactggtaatcagagaaatgcaaattaaaacaaacgcat
atgcattttacttaacagactggcaaaaatgaaaaaagaaacataatatcctgagctgg
caggagcacaaggaaatgggtactgtctcgtgctgatgatgaatgtgaattgataacagt
tttttgtgatttgcgatagcacaaaattgaaaacagcac >IGR3125a
tcactggtaatcagagaaatgcaaattaaaacaaacgcatatgacattttacttaacaga
ctggcaaaaatgaaaaaagaaacataatatcctgagctggcaggagcacaaggaaatggg
tactgtctcgtgctgatgatgaatgtgaattgataacagttttttgtgatttgcgatag
cacaaaattgaaaacagcacaaatgtacgttactctgggctcgctaaataggcactaaat
aaaacgagtcagtttcttctcccgagcaagtaaactagagggtagatccacgcgacccgg
agtctaggacacatcctcgggagtgaacagccacaattcacagacgatgtgtgcagccgg
ggcatgaaaggcccaaggcaaaccccaccacgaggtaaacgcccggactctgaggagaggg
gtggaagccgggacttcgaggaggggtggaattgacttagagacaggagggagcctcttg
gagggcaaagctgccctgggcaagtgttcttttctttctaaaccttccttctggtctctg
tctgaaatttaagcgcgcccctggtgggggagagaggaagggaagaaaaggggtct
cggaggagaataaagtgctcgtgggtggaagaaacctggaacagaaaatgccagaaaaac
ctggaacagaagtgcagacggcccgcggcggcccggtga >IGR3126a
caagtgttcttttctttctaaaccttccttctggtctctgtctggaaatttaagcgcgcc
ccctggtgggggagagaggaagggaagaaaaggggtctcggaggagaataaagtgctc
gtgggtggaagaaacctggaacagaaaatgccagaaaaacctggaacagaagtgcagacg
gcccgcggcggcccggtgatctccacactcaatcaccctctccaggggagcgatcgctc
ctgaggctgccagcaccccaccaccaccccaacccgctagtgccgatgacggccacaga
ggcctttctcgcccccagctcacctttgcacacacagttcccccgtgcagagtttgtgcc
tccctcatctcttagttctcagctaacactttccctgaccccacccaggtcatacctcct
gtcgtcgcgccgcacgcagcatcccagacctcaccttcgtattactagagctggcccgtt
gtgattcaggtctgccttccacccaggctgtggccccttcagggcagcatggtacccgt
cctgctcactactgcacccagagcctaggacatgcctggcacctaagcagatactactgt
actcgggagccatgcatggcctgcgcaggagggtggcaggccaggtgacaggttcaaggt
ggagcagaggagctttattagagggacagggtgaaacata >IGR3127a
acccaggctgtggcccccttcagggcagcatggtacccgtcctgctcactactgcaccca
gagcctaggacatgcctggcacctaagcagatactactgtactcgggagccatgcatggc
ctgcgcaggagggtggcaggccaggtgacaggttcaaggtggagcagaggagctttatta
gagggacagggtgaaacatatttacaccggccgagcagggaccttaagaagcaggggtgg
gagcagggtcccagctcagacgagttccaccttggcattgggtacaccgccaccacgtc
gtagccctcggcggcttcacgcgcgccttggcgtggctctcacagtagagccgctcgtc
cagaaagaagtaaccacgctgcttgaggttcaggccgcagtcactgcacatgaagcactc
gggatggtagagcttgtcccgtgccttgacgatggtgccctgatgggggaacgagaca
ggacagcgtcgagtgactgatgggttcacgactgcgcccgcatccagggcccctggaaggc
tagggtccggagggggcagcggggcggttactcacacgatgccgtggccgcagcgcgtg
cactcgggcagcccctgcaggccgctcagcggagcgcccagcttgctggccgtgggcttg
aggttccggggggccgccaggcccaggccaatcccctgaaa TABLE 5-continued >IGR3128a
tgggttcacgactgcgcccgcatccagggccctggaaggctagggtccgggaggggcagc
ggggcggttactcacacgatgccgtggccgcagcgcgtgcactcgggcagccctgcag
gccgctcagcggagcgcccagcttgctggccgtgggcttgaggttccgggggccgccagg
cccaggccaatcccctgaaacccggagcgtaggtggcatgaacgggtgaggaggtcaga
actccatttctgcgggtgtttggttgggcgccagacgggccatcggcacccgagactgg
ggaacgggtttggcgggcgtgggtgagggcagcgacaggggtgggagagggaatcagg
aagccagggcgtagcaaggtcgtagcaagggcgtgggacccgggccgcagagaccgaagag
ggcaggtgactgcgaggcgggacgtggggtcgctagggggcaacctgggcactgcaggga
gtgggaaggcagatggggacaggtggcaggcgtcttaccgccctcgccggcctctagcat
gccctgcaagtagcggaaggagcctgactgcttgggctccgcggccacgggctcggccgg
ctcccgcagcatcctgtacacctcggagcccaggtcgattctgcagtcccggctccgcgg
gaggcctctggctgggtcagcgctgggagggagaaagaaa >IGR3129a
aggtggcaggcgtcttaccgccctcgccggcctctagcatgccctgcaagtagcggaagg
agcctgactgcttgggctccgcggccacgggctcggccggctcccgcagcatcctgtaca
cctcggagcccaggtcgattctgcagtcccggctccgcgggaggcctctggctgggtcag
cgctgggaggagaaagaaatagaggaggaagggatgcagttccagccttcaccctgtgg
acttgggtctggtaaggcttatgagtcagaatgcaaccagctaagacccaaggatcaag
tgtcaggggtcagagtgggactgggtgagatttgagggatcaagggttaagatgggttct
gggcatggcaccgaaggcatctctgtgctacctggggggtgggagacacatgcaggtgct
catctgggctggcagggtggcctcgctgctgccattgtgagggactggaaagcgagggg
ttgtccatatggagatcccaggcttggtctgccatcttctggcccgtactccggtgcctga
gggccgcctgctggttgttgggctgccgtcctattagagagaggcctaaggcactgggag
accctctggcctccagccattccttgttcaccccaccccacccctgctgtgctgtgccag
gtggtggatgtcagttggcttcctctgcttcggcatctct >IGR3130a
ggcttggtctgccatcttctggcccagtcccggtgcctgagggccgcctgctggttgttg
ggctgccgtcctattagagagaggcctaaggcactgggagaccctctggcctccagccat
tccttgttcaccccaccccacccctgctgtgctgtgccaggtggtggatgtcagttggct
tcctctgcttcggcatctctgcctgtggtgctcagccagggaagggatttctggggaag
ggctgggcctggggactggttatgcccctgcagaatgagaaacgtccttggaaagtcag
acacaaaaacctgggcagctgagactcagcctgggcttgtgagccctgcagtggttctgc
ccaccaccactcaggaagggacagtactggggcaggcctatcccaagaagcctaaggtct
gtgtggctacagcagagtatgtggcctcctggcagaggtggccctggtgccaagccttct
caccttcctgaactgtggtgggtactgggtaggcccatggctgggaactcaaaaaacgta
actcctgtcctacagtcagaaagggtccttgactgtcatgtgtccaaggcccttgggca
ggctgaagctcaagagtgccattgtgaggtcagcccttctgggcctacacctgtccccc
attcctgctttccaggccacaatgagtagccttctgcag >IGR3131a
ggtactgggtaggcccatggctgggaactcaaaaaacgtaactcctgtcctacagtcaga
aagggtccttgactgtcatgtgtccaaggcccttgggcaggctgaagctcaagagtgcc
attgtgaggtcagcccttctgggcctacacctgtccccatttcctgctttccaggcca
caatgagtagccttctgcaggcacagcagatgaggggcagagaccaggctagggctcaag
gctctctgccccactacccacagccagcctggtgcccatggctgaaacattttgggtgg
gagtgtcctgaacctgccccctcagccatgaggagagggcagtatctctgtgtgtgtggg
tctgagtggggactggggatctttgtccctgcagagtccagagctgtgcagttcccagct
tgcaagtgcacacaagcaccccacagcaatgtaaacaggggcatgcacactctcacaatt
atgctttaaagacacacacacacacataaggacaacacatatgcacctaccaatctccct
acatacaactaactacatgcgcatggttacagagacttggagccagcactggtcaccctg
ggaatggccatagtggcctccatagctgagactgggctagtagccagagcagcctgatttt
taggatgatgtctgaggccaggccatggggtaggtcttag >IGR3132a
cacacataaggacaacacatatgcacctaccaatctccctacatacaactaactacatgc
gcatggttacagagacttggagccagcactggtcaccctgggaatggccatagtggcctc
catagctgagactgggctagtagccagagcagcctgattttaggatgatgtctgaggcca
ggccatggggtaggtcttagcctcagcctgggagtgacgtgtaaacctcctctgctctac
agtgtggtcagagagcccagtgtggacaggaaaggatgcctatcgtagtgggaagaaccc
tggtttggacttaggaagctctgaggcatagttgagcctgtggggttctgccctgagtac
cccctgcttttgtagggtgggaacctggggaacaggcagaccagcagttgggtgggccc
ccctccatttccccaccccaacagacaaacaggagggtcttgctgcccaggtggccccc
atcaatgcagcagcaacaggaaaaccctatccacatcaggccaacaaaaagccctgag
aaacgtgagcgctctcacacgtgtgtctgtcgggcaggcatgcaggcagggctgacctct
aatgggaccagatgggctgtggccagtgggggtgggctcagcctccgggcagaggctt
tggtgggaggaggagttggagggactgggactgggagga >IGR3133a
aaaaccccctatccacatcaggcccaacaaaagcccctgagaaacgtgagcgctctcacac
gtgtgtctgtcgggcaggcatgcaggcagggctgacctctaatgggaccagatgggctg
tggccagtgggggtgggctcagcctccgggcagaggctttggtgggaggaggagttgg
agggactgggactgggaggaaggaggccctcactcaccccctacccagcagggtgcagggg
tccactgcagggccatcagagccactgccctcccacggtcacccatgcagctgcctctc
taggcctgaactctgtggctaggacacacatggctacctcagttttagtttgagtcccag
ggttatcccctaactgggcaagtctcttcacctctctgaacctgtttctttatctatgag TABLE 5-continued ctggggaatgtgatgctttccacatcaggttccttgtggagatgaagtaagacaattgca
tagtgcctggcataaagcacatacttgttggatgaatggctgtcaggggaattcctgggc
ccccagtcctgtattttccccctctgtgggtggtacacctcgtaccatatgctcctctgc
tctgagaaccagcctgctgcccacttggttgttgaagcctcagtggattttttcagcagga
tgggggtaactacctgctttgggacactcaacttggatgg >IGR3134a
atacttgttggatgaatggctgtcaggggaattcctgggcccccagtcctgtattttccc
cctctgtgggtggtacacctcgtaccatatgctcctctgctctgagaaccagcctgctgc
ccacttggttgttgaagcctcagtggattttttcagcaggatgggggtaactacctgcttt
gggacactcaacttggatggaggcaggcgctgagtccagatgagcaggtgccatctccta
gaggctcagttctagctctctgctggtctggggaggacaggctgagtgtgcaaggactgc
ctgctccacctgacttgcttctccccatcacctggttctgagcataattgccactccttc
cagaaaaccctactaacccagaaggatagtaataagttactatccttcctccaccctggg
ctaggccaagtgcctcctgtgttcccacaagaggcctgagagaaggaggttctcctatcg
ccccacagggaaggtgggcctgaagttccagctggcctgtcccatcccactcggggatg
tgtgccagggcaccttgtgctggtcctagggccaactgtggtttcctcctcctcgatggc
tccagctagctccaccccctccccaacaccccccactcaggcagagggtgggagcagcatg
gggacaatgggccctgtgtctgtgttagcaaggactcagc >IGR3135a
tgaagttccagctggccctgtcccatcccactcggggatgtgtgccagggcaccttgtgc
tggtcctagggccaactgtggtttcctcctcctcgatggctccagctagctccaccccct
ccccaacaccccccactcaggcagagggtgggagcagcatggggacaatgggccctgtgtc
tgtgttagcaaggactcagccctgcagggtgggtggggtgtttttgtcaccacccat
ggagcccatgacctttaagtacaaaagtggggcagcagctgaggggctgccctggtgct
tgtggaaactccctccttctccagtctgagccactggcagcctggtcttcaaggagtca
atgagaacaagtgtgggggcaggggagctgctctacagtcgccagcctccaggcccac
cggccctgagcctctcctggaagactgaacccctccccaccacgtcatcctggcactgc
tacctctgagggaggctgggcctcatgcatgagcttgagcccacaccctgctgctcccc
tctgcctggcctgtggcaaacctggctcatttgtctatggcaacatgtaccctaccccct
aaggtctgggtccatgggccatcagagcaagtttctgagacacagatgtggccatgaa
tccctgtaagaacagctgaggtccaggatagagaagccca >IGR3136a
cctcatgcatgagcttgagcccacaccctgctgctcccctctgcctggcctgtggcaaa
cctggctcatttgtctatggcaacatgtaccctaccccctaaggtctgggtccatgggg
ccatcagagcaagtttctgagacacagatgtggccatgaatccctgtaagaacagctgag
gtccaggatagagaagcccaagagcctttctgtggccctgctccaccacctcatctctca
cctctgtcctctcactccttccatcttgtcctcccttccctggacctttcttttctctg
aacttgtggtgcaagacctcacctctgggccacacttcctctccctataccccttgcct
gccttaccattcctagcccttcaggtcttggcttcaataccccttcctccaggaagcact
ccttgactccttgtctgagtcatgtgactactctgggctcctttggcccctggcttcccc
tagcccagaacttctaagtgcctttcccctgccagaatgggcactgcctggaaggtggta
agcatctggctccagggatgccagccaggcagggtagggaatagagcaagatgggattgg
ggtagatagtgagggagaagctggggcacatccttccctctggttcagtgaagcctctcc
ctgccttggccccttttctttcatgttgagagggtggaca >IGR3137a
cctttcccctgccagaatgggcactgcctggaaggtggtaagcatctggctccagggatg
ccagccaggcagggtagggaatagagcaagatgggattggggtagatagtgagggagaag
ctggggcacatccttccctctggttcagtgaagcctctccctgccttggccccttttctt
tcatgttgagagggtggacaaaggcaggcccaggaggcaatggtcccacatgctgggtcc
catggttctggctccatcacagaccatcccagtctccttgcccaaactctgtggcccaga
gatggctctggatacctcagtcatccccacttggctactccttatgccatggcaaaacaa
ggccctagaatagcctgacccctcactcttcttgaggacaggaccagagatatgacttc
tatcacacacagaaaggtgactgggcagacaggcctgcagcctaagttctgctagaagca
ccacaggatggccaggagagaacttcaggcttggatagggcactcagaggagtgtcccat
agcctgaggtcactccacagcctgagactgccaccaatctcccccgctgcaagcacagtg
acttcttttctggtctggcatcactgagcaccagagtgaactccagctggctgtgtgatag
ccgcaaaccaaggcctagcccagatcctggacatcatagg >IGR3138a
aacttcaggcttggatagggcactcagaggagtgtcccatagcctgaggtcactccacag
cctgagactgccaccaatctcccccgctgcaagcacagtgacttcttttctggtctggcat
cactgagcaccagagtgaactccagctggctgtgtgatagccgcaaaccaaggcctagcc
cagatcctggacatcataggcaccttggtccagaatccaggattgcccggagtagagaca
gagcccacaccaggtgctcatcatctgaggaacatgggatggggtatggatgtggtccag
agaaaacttctgcttcagtctctgtcttgggtatctgagagcccagtgaggacattcag
tgcaggtgaacctgcatgctggcccctctgccctgggctcactctgagcaggccaggcc
aggcagtgtctgtacatacctggatctcaggatcgatgtggatgtgtgcctggagcct
tgctgtcatcaggggcactgggccagctcctaccctcaggcctgtggcagaaattgtgat
ggtcagatatgtctcctaccacgccaccatgcctgggagccaggatcaagaggggctgg
gctctgggctgtgccctgcaggtagaagaacaccactccagtgctttcccctgtaccaca
atggtgactgttgtggcaatgagccacaactctagctgcc >IGR3139a
ggccagctcctaccctcaggcctgtggcagaaattgtgatggtcagatatgtctcctacc
acgcccaccatgcctgggagccaggatcaagagggggctgggctctgggctgtgccctgca TABLE 5-continued ggtagaagaacaccactccagtgctttcccctgtaccacaatggtgactgttgtggcaat
gagccacaactctagctgccatcctcctgggtagggctatatgcttctgtcccatcgg
ctgcccaatccctctctagtctggttcctggagaggctgcaggagaagccctgtgtcttc
cctaatcttccaccctcttcgtggcctacagaagctcagctcaaagagcccagcttata
gcactgcaagccaggcctcacacattgaccagctagaagcctatccacgcatcctctggg
catctacagcctctggtggggtgtgggtcaggcgtccgtcggctctggggtaggtggaa
tggaggctctgaggggtgtgtctttcctcctgctgctgctgccggcagagtcatcactga
gtctgcccagcccagatgggaaacaggccattaggaaattcctgcttcgccatagaaacc
aaaagccaaacaccactcaggagggagaaaaacatcataaacctgccataagcagggcag
gcaggccgagaggctacgtgcctaaggcccagccctgtca >IGR3140a
tctttcctcctgctgctgctgccggcagagtcatcactgagtctgcccagcccagatggg
aaacaggccattaggaaattcctgcttcgccatagaaaccaaaagccaaacaccactcag
gagggagaaaaacatcataaacctgccataagcagggcaggcaggccgagaggctacgtg
cctaaggcccagccctgtcactcagtagccctgtgagaaggcaggccaggaagggcatg
gaccctggactggcaggtgggtatgaggtgaggctggttagaccaaaggggaataatgcc
ctccaactcaccccacgaagcctcctgaggcttctcaaggtctcattactgacctagcag
cttgcccctgcctcttctgcccccttcagttgagggttttaataatctatctatgcctat
ggtccatactcactctgcacttcctcgcctctgcccattccttagtccctttggaggctac
ctctctactccaggcctttggtattagagctctgctgccccagggcaacaccagccccat
agtccctgtctctagcccctcaaccaggctcccaagtgggtaccctaactcacagctct
aactgtggcctctatctactcagaactcctctgggataaagctgggacatcttgtgtggc
tatttggccttcaacttccctgaagttctgcccagaagag >IGR3141a
gtattagagctctgctgccccagggcaacaccagccccatagtccctgtctctagccccc
tcaaccaggctcccaagtgggtaccctaactcacagctctaactgtggcctctatctact
cagaactcctctgggataaagctgggacatcttgtgtggctatttggccttcaacttccc
tgaagttctgcccagaagagcagtacaagcctgacgtctaaggtcgaagggcacaaagta
cccagagccattaatgtggcccaatgcatcagatcagaatgaagggcttaatcatgtgtc
aacccccatcccaggctgggctctttaaacaaaatgacaggcaaagggtaggctgtgcaa
aggtaccttgggccacatgtgatggacaacagggactctatcagtggcctcagtgttgga
gttgatgtcagaaaggtcctgacctatagaacatgcccaggaagtgtgattttgcttgg
attgttggatgcctggctttgggctcaaagcaaaagaagcccagtggggaagctgggcct
ttgatacacttttcattctgtgggggagttggtgggggattagagctctctgtacacaa
gagggcagatagggaagctggtctggggtagaaccctgggagtgagagcacagggtagct
cactccagccagctcaacaggctgatttactgcagagccc >IGR3142a
gggctcaaagcaaaagaagcccagtggggaagctgggccttttgatacacttttcattctg
tgggggagttggtgggggattagagctctctgtacacaagagggcagatagggaagctg
gtctggggtagaaccctgggagtgagagcacagggtagctcactccagccagctcaacag
gctgatttactgcagagcccttgctgtgtgggtgtgtgtggtgggggcggggaggagtgt
cgttggggccaggcataggtcctggcatagcaggcaagataggagcagagtcagaaag
cttgcaggtgggcaagtgtccaggagaagaaatgttggctcagaaagtcaaggtggccct
catgtcttgatcccccagagtctgcatgtgtgagggctggagatgggggctgcagggcag
gactcaggttttcactctgactgagcaggcctggtacatcatcactcaatgtccagagcg
caagatggtccatattttggttgaggaagttatgggctcaagagattaaatcactttct
ggagcacagcatagttatctctccctctctctcttttatgggtaaaattatgagcataat
tctcaacccagctctgtaatagtagagaatgtgctctcatctgctccatggccagtgaca
ttttggggctgaaatgctcagagtggaacaggtcagtgga >IGR3143a
gttgaggaagttatgggctcaagagattaaatcactttctggagcacagcatagttatct
ctccctctctctcttttatgggtaaaattatgagcataattctcaacccagctctgtaat
agtagagaatgtgctctcatctgctccatggccagtgacattttggggctgaaatgctca
gagtggaacaggtcagtggacctctggctccatccatgcctggtttggaacaaaggactg
gggaaggaaggaaggaaggaaggaaagaaggaggggaccctccaccccaccaccctccgc
tgacatcatacactctgagaagctcctgactcaggcccctctgaggcactcctccccac
tactccactaccactagggctgcccttgttcagccacacagagtcaaggctggaggtgag
tcagggccaggatcccagccaagtggggaagcttcagaggtcactcatgggcagagcca
tgctgacatttcccccatccagcctgtatctcagtctggaggagggtgatgaatgtgatc
cgttaatgggaaaggaaaccccgggctcatagaggtcatctgggcacctaaggctccaga
ggctggatgaggaccagctttgctgaactccaaagatggagcatcctcaccgtgtgccag
ggccaagcacaaacagggctgacctcacaggcctctccac >IGR3144a
agcctgtatctcagtctggaggagggtgatgaatgtgatccgttaatgggaaaggaaacc
ccgggctcatagaggtcatctgggcacctaaggctccagaggctggatgaggaccagctt
tgctgaactccaaagatggagcatcctcaccgtgtgccagggccaagcacaaacagggct
gacctcacaggcctctccaccatgtttaaaggctccaagccagtggcttacctcccaccc
tgccagctcagaggcatggttagctgtgttgtggtttggggaggctttgcccacgtactt
ccacaggggtcatggaaatcccctcagcagtgaacacggcagagctgataagttatgcc
cgacttctgtggatcaaggtgggcaggggagtggggagatcccactcagccaggcttagg
ccaactgcttctcagagctgagtaaagacccaggacctgagcaaggctgggtcccccac
cccaccccagtggaccttctatcccaggatcatttatggagcacagatgggcttggta TABLE 5-continued acccccctgtcctccccttcttgattggctgcaaagcattacacagtccttagtgggaact
tttcccaaatccagatttaaccagggcagaggtgtgggccacggtggcgacagctgtggc
agggcagctgagggctggtaggagtagtcagcagccaag >IGR3145a
ctatcccaggatcatttatggagcacagatgggcttggtaacccctgtcctccccttct
tgattggctgcaaagcattacacagtccttagtgggaacttttcccaaatccagatttaa
ccagggcagaggtgtgggccacggtggcgacagctgtggcagggcagctgaggggctggt
aggagtagtcagcagccaagttaagggtctgtagtcttaggagagagccccaaaatcaaa
ttttgctacccactccctctctgtgtgactttaagcaccatctaacctttctgagcctc
acttgtctcatctgtgaagtggggactatagtagccctttttaagttggtaaatgaggg
ttaaatgaggtgttgcacaagaaactactttgaaatggtcatcaagctggtcactcaggg
gaggggaaaggaatgaaacaaatgccccagaggctattcaaggtcttatttcagttgcct
gcaacacttgccataagtgccccaacacacttctagtctaagttaaaagggatttcttc
ccttcttaagctataactctaaacagtatctgccaggcccccatgaaagtgctactcctt
gggactgttcctggatggggcacccaggagctgaggcagagaggctgtgtgaagctgggc
tcacccaaaatgccagctgcccataactgcccacctcgtc >IGR3146a
cccaacacacttctagtctaagttaaaagggatttcttcccttcttaagctataactct
aaacagtatctgccaggcccccatgaaagtgctactccttgggactgttcctggatgggg
cacccaggagctgaggcagagaggctgtgtgaagctgggctcacccaaaatgccagctgc
ccataactgcccacctcgtccttccatcctcccagcccagcccacctgtgcatacctgct
cacagacagtgtgaggtgatcgtggcagcccttgatgcggttctgtgcctccaggtgtgt
catgagctctgtgctctcaccattgatggcctggatcaggtctcctgggcacagggcagc
caatgcagccttgctgccagcatggacctgcgagcagacaagccagatggctgggcacag
tcatgatatggtcttgctgcaagctgtgccctaggcctcctccaacctcagaacctagcc
agtgtggcctgctaccagcatggcctgtggatgggcaagccgagtggctggttgaggtcc
ccatgtagcctggctgcagccttgctggaaacacctccaactccagcacctggaggcctg
gcagggcatgaggatatacaagaagggcttcctcagggctgggacaaatggatgttgttc
ttgcagcctgcgtatgtgcccaaggacatgcaggggacac >IGR3147a
tggcctgtggatgggcaagccgagtggctggttgaggtcccccatgtagcctggctgcagc
cttgctggaaacacctccaactccagcacctggaggcctggcagggcatgaggatataca
agaagggcttcctcagggctgggacaaatggatgttgttcttgcagcctgcgtatgtgcc
caaggacatgcaggggacacagagacacatgagacataggtgctcacagatacatacac
agcatggacatatcacagatacctacacagacaagccccaaccagacagactacacac
cttgacctaatattcaaacccttagtgaccttgccttcctacttgcttgatttcaactct
catcccacctccacacccacactctgtccagaccatgtgaatgtctatggggtgctcac
aggcaccatatatcactcacctctacacttctgcaaaagctgctccctccacctggaaca
ttcctttgactcccacatcctcatccttcagatctcagcatagaggccacttcctctggg
agcctctctgggatctcactacccagtgtgctcccatgaccaccttttcccctacactg
ttcatgttaatacttcattataattaaaatgggaaggtctgaacatcacctccctgagca
agtccagggccatccagttccagctgacagcctgcgtttg >IGR3148a
tcatccttcagatctcagcatagaggccacttcctctgggagcctctctgggatctcact
acccagtgtgctcccatgaccaccttttcccctacactgttcatgttaatacttcatta
aattaaaatgggaaggtctgaacatcacctccctgagcaagtccagggccatccagttc
cagctgacagcctgcgtttgggggtcagaattctacctctacttcccctgcaggacagga
actcaggctacctcagtgccactattgaccctcggggtcaagcagtgttcacacctgga
agctcttacaatgctggtcaactgaagaaggctagaatgggggtggagttagactcaca
gagatatctaagtaagcaactcaggggaatccaggccatggagcaccctccaccctgcct
tgaccccaacatagcctttagaaatatatttcttacccagcctctccagccagtgcccag
ctggttcaaaagctgccagtgaccccattcttttgggtgggagctcctactggtgggaac
tcctggaagcccagctaggctcagttcagccaggtctcagtagtgagtggacaaagctga
ggtgctggcagctccttggctggaggcctggtgttggcactgcccaagctgacctgccct
gaagtaggctgcctcaaggaaacgttcttctgaagcatga >IGR3149a
gaccccattcttttgggtgggagctcctactggtgggaactcctggaagcccagctaggc
tcagttcagccaggtctcagtagtgagtggacaaagctgaggtgctggcagctccttggc
tggaggcctggtgttggcactgcccaagctgacctgccctgaagtaggctgcctcaagga
aacgttcttctgaagcatgacaccctcanccaactagcccatcattaatgttcacttgta
gggcctgggcacctgtgcaagcctgtcatcctgggggagacacccacttggcaccatccc
accctccctcaaggccatcctctgcctcctccccttcatggatacctgccctgtgccag
ggcctgggctctatgctttacccataactagctcacagcaaccctcaaccacctggtga
ggcagaggctgttctcatccctattttacagatgaagagaaagaagcttgggggaggat
gccatgccccagtccccacactggagaggagtctttcttcaggggcggctaactgcggc
aggatgactcagccagcacaaggggtacattcaggcttctgtgggcggaggaagtttctt
gaaagcagtggtggctgggatgctgccagctctattgagctaggggagttctggtcagag
agggcgtgaggccaagaaattgtgactctcccagtcacct >IGR3150a
ctggagaggagtctttcttcaggggcggctaactgcggcaggatgactcagccagcaca
aggggtacattcaggcttctgtgggcggaggaagtttcttgaaagcagtggtggctggga
tgctgccagctctattgagctaggggagttctggtcagagagggcgtgaggccaagaaat
tgtgactctcccagtcacctttacatgcattatctcattaatcctgaaggcaagcccatt TABLE 5-continued tcctagatcaggaaacggaggtccagagaagtacagaaggatagttaattgataaaagac
tgaatcaagatttcaatccaggccacctgattccaaatttaaaactatgctcttaacacc
tgcatttttcttccaaaggggtaagggaaaagagagtatctgagggagagatagtgttc
caggcagaaggaccagcatgtataatggcatatctggagagaaagaagaaggaaggttgt
atggccggagcatcatgagtgaggggagagtgggagagatgaagtcagagaagaggcagg
gatcagatattgcagagtcttgtacacccgggtgggaagctggcatttctcctgggtggc
tgggaaccatggagggctctaagcgggaagtcacaggacagagtggaattcaggccgatc
cgtctagctcctaagcacaggataaacagaaagaaggaac >IGR3151a
gagggagagtgggagagatgaagtcagagaagaggcagggatcagatattgcagagtct
tgtacacccgggtgggaagctggcatttctcctgggtggctgggaaccatggagggctct
aagcgggaagtcacaggacagagtggaattcaggccgatccgtctagctcctaagcacag
gataaacagaaagaaggaacagagacaggaacagtgaagtcaggtgggcggtgagggcat
gaatcagccccttaccggtagtggctgcattcccagccctgctccacccagcctagatg
tggtgggctgggagtccaagtcagaaccaggtgccacattgtcctacacagtcacagcaa
actgcagactgcctggattcctcctgtctccactctgcttctctgggttgattacattag
cctctctgtgcctgggtctccatctatgtaaggccagagggagtccttacttntaaaggc
tgttgtaaggactatttgagaaaaacagggcatgtaaagcccccacaggaggctgggcat
aaggtggtgctcactacagggactggagggagctgttaccaacacccattagggtagggc
ctggcacaccctggatgcttggccaaggccagccatcattatagcttgtggggaaggagc
cccggatgatgttcttgggactcctggaggcttcatgggc >IGR3152a
aaaaacagggcatgtaaagcccccacaggaggctgggcataaggtggtgctcactacagg
gactggagggagctgttaccaacacccattagggtagggcctggcacaccctggatgctt
ggccaaggccagccatcattatagcttgtggggaaggagccccggatgatgttcttggga
ctcctggaggcttcatgggctgagattgcaagcccccagccctgccgggccgatagcctc
ctccctgtctgtgaggctgtccctccctaccaggtcccgcgtaggggaggtcctggaa
gcaagggaggggctggatcttgagccccactggtgaagacactcccacatatcttcagtc
cctgtagacctgccccagaggtacctgctaggcaagctgtggcctgtgcctcccagcgc
tgtaaatctccccagatcccacccaaacccaacctcagccatcctggctccttgggcctg
agctgctgccgcgtgactttggggacaaaggaggctcttcctggcaaaccttctcccag
actgcctgcctggggcctgcatcccagtcagctccaaacaaggctgttgctgctgctgc
tgccgcagccgcagctgtgacgtgtggaggcctttcctcggagggcaggcagccgcgtgg
gcaacagatgtctcagctccctgccgcctgcagccgtcag >IGR3153a
ggggacaaaggaggctcttcctggcaaaccttctcccagactgcctgcctggggcctgc
atccccagtcagctccaaacaaggctgttgctgctgctgctgccgcagccgcagctgtga
cgtgtggaggcctttcctcggagggcaggcagccgcgtgggcaacagatgtctcagctcc
ctgccgcctgcagccgtcagccgccgccactgagcctgtcagcggcctcacgcccaggt
gcctggccagcccgcttagtgtccccaccagcccccctcagcggacacacagcatgacaca
cacaagcagacacaggcttgcgtacacacacacacacacacacacagcaggaatcc
tataggaaagaggagatgaaaggctctgggatgtgttgaaggcccacctcactcggcccc
agggacctggcagtgagggcagatgtgggaagcctcctaggacagctgggcctgcctgtc
accctggcccccagaaacgggattccatgattccacgctccacctggtgcccaccccctc
ccaagaactggacagaagtctcttaaagcccagccggcttggcccagcccccatggcaag
aggtggcagtagggtgggggaaggtgcttctctgtgcctctgacacaggcccccaaagac
aagatcagcctgtgtgggagcaagggatggccgtcagatg >IGR3154a
gattccatgattccacgctccacctggtgcccacccctcccaagaactggacagaagtc
tcttaaagcccagccggcttggcccagcccccatggcaagaggtgcagtagggtgggg
aagtgcttctctgtgcctctgacacaggcccccaaagacaagatcagcctgtgtgggag
caagggatggccgtcagatggtttcaggttatctcctctgctccttccagactgagagcc
gccaagggcagggcctgggttctctcctcttctgtcccttaggctggggaccccaaggg
cagggtctgagtcctctcttttggccctccagacacgaggatgtcgaggctgggccagga
tcctgtctcccctagacaggcaccccctcgaacagggcctgagtcacctcctccactcct
ctatcctcagactagccacgctccagggctgtgccggctccttttccttctctgtgggca
aggcagggccctgggaaacttgaggaacgggcctgaggctgtcctggcccccggctttgt
gtcatcttgtgggagggtctcacaacctcacagttaagtctcccttccctggaagc
caaaattcctcctggtcacttcccttagggtgactgaggtcgtgaatgagagactgact
cacgcccaaagtgggaagtggatggacctctgtcttctca >IGR3155a
tgaggaacgggcctgaggctgtcctggcccccggctttgtgtcatcttgtggggaggggt
ctcacaacctcacagttaagtctcccttccctggaagccaaaattcctcctggtcact
tccccttagggtgactgaggtcgtgaatgagagactgactcacgcccaaagtgggaagtg
gatggacctctgtcttctcagattcagcgaggaccccagacctccctgggtcaccaagct
ctgccggcagggaccccctgatagggggaaggggggctctaaatcattttgccccagatctt
caggcagggggtgagtctgaagagtttctgggcctctgtagagctgtctagaccctggc
ccatctccgcgggtccttcccgggtccacagtggctccccagatgaggccagcgggag
gcgggtgcgtgaactcttgggagattcttcgcgggatcgggcagacaggcccagcgtggg
aggagggcggctgggctgcctgcctctgcctggaagcgcctctacagcatgcgggggtg
cccaggccaaccctccgccttcaagcctcggatacacagggggatctggtcccgggcgga
ccgcgagaacccggtctcagacatgggaccgcctgccgccacgcagccgccagactcac
ccgtgagatggtgagggcgcgctgaagtcccggccgccc TABLE 5-continued >IGR3156a
ctgcctctgcctggaagccgcctctacagcatgcggggcgcccaggccaaccctccgcct
tcaagcctcggatacacaggggatctgggtcccgggcggaccgcgagaacccggtctcag
acatgggaccgccctgccgccacgcagccgccagactcacccgtgagatggtgaggggcg
cgctgaagtcccggccgccaccaggcggaagccccaggcgcgaaggcccgcgcagggtca
cggaatggggcatcgcgggctggagccgcagccggagcctgagccggactctgaggagcc
gccgccgccgccgcctggacgccgcgccccgccccggcccgccgccctgtcccc
actcggcccagccccgccccgctccctgtgcgcctggattggccccgcggccagcccg
accctcccacttcgggggctctgaggacccgccctcagccccggctgccggcaacccgg
caccccactcagctctcagagatccccgcgttcggacggccccgacggcctggatcctg
ctcgggccttggatctgcaggccgcggacccaaacccagctgtcgacaccggcccttga
agtcgcttttaggggcggtgctccagccngaggagggatggagggccccacttgggggatg
gggctgccccagctcagatacctcctcatgggcccgactg >IGR3157a
agatccccgcgttcggacggccccgacggcctggatcctgctcgggccttggatctgcag
gccgcggacccaaacccagctgtcgacaccggcccttgaagtcgcttttaggggcggtg
ctccagccngaggagggatggagggcccacttgggggatgggctgccccagctcagata
cctcctcatgggcccgactggcacacctgcggccatcctgccgtgtgaggagccctctg
aaccaagaaccctatgaaccaggggcttgcgcagcactgggccggggacgcagacccaaa
acgacagcaggcagcgccgagcgtgggagtggacacagaaaggtcctcagactagtttgt
ggaggccagtaaggcttcctggaagaggtggtccctgacttgtatctggaagcaaggtgt
ccctgcttcccagaacattcaggccttctcttgctgcttgcaggctcctcgcaggccac
ctccctgtctgcacagcccctcccctcgtccttttgccaggagatttgtttcccaggtc
tcctgagaaagtagcagctggagcggctggggtcgtggctgcagtgtaaagggaagaa
atatatgcagcgcttcactttgggccctttctctccaaggtcttctctccattcccaac
cattatcctccggggatgtacttgaacagccaatgcagat >IGR3158a
ctcccctcgtcctttgccaggagatttgtttcccaggtctcctgagaaagtagcagctg
gagcggctggggtcgtggctgtgcagtgtaaagggaagaaatatatgcagcgcttcactt
tgggccctttctctccaaggtcttctctccattcccaaccattatcctccggggatgta
cttgaacagccaatgcagatgccatggcaccaccaacctccctctggttctctcggcact
tctatctggctacatcaggagacacctttttacttttccagactctgtggaggtctctca
tttagcccaaatccttaaccttatgtgtccttttagtcaagctgtgataaggaccctgct
cttgggctcctcacaggtggtgggatgaaatgtgtccactgggtctctgacaacccgcaa
agaggagaactgcttgagaagcacaaacctagggcagtccagtgaaggaggagggcccttc
anagtagaatgtgggtgcctctgtaggaggcaagatgctgctatctgttcagctgggaga
gaaacaagtggtgtgtggtagcggtgtttatatgggagtgtatttgggtgtgtgtgtgt
gggggggtgcggtgtctgaatccattagagcaccagccattgggctgttctccatcactt
tgtggtggaggaggtttctgctcagccccttgcagacttg >IGR3159a
ctgtaggaggcaagatgctgctatctgttcagctgggagagaaacaagtggtgtgtggta
gcggtgtttatatgggagtgtatttgggtgtgtgtgtgtggggggggtgcggtgtctgaa
tccattagagcaccagccattgggctgttctccatcacttttgtggtggaggaggttctg
ctcagcccccttgcagacttggatcccaagtgaagaaaggtggaagggccagcaggagagc
tggtcactgcattgtctctctgaggtctgtaggccagaagctccccaggacttagaccct
actaaatggggtagagagtaaggggcagccatcacttatcactggctgtcctgagggttt
ggtgtacagcatggcttggtcagaggcctgtcagctgggctccaagatgtcctagtgaa
tgtaaacagtgcagaccttttctgggggggaagggatcctcaagggtctgtggaagcttcc
acccaatgtatcccaaagtgaattcctgaaactcctcttcatacattgcttgtttccccc
gatttcacatcccaaagactgcctacactccttgcctccatcctgaaattccttcattac
ccgtttacttctgtccgggggaatgtgaagtggtcctcctgaatatgaccttcctggccc
ctgagtctctgggcagtgtaatccatctccaaaggcttct >IGR3160a
aattcctgaaactcctcttcatacattgcttgtttccccgatttcacatcccaaagact
gcctacactccttgcctccatcctgaaattccttcattacccgtttacttctgtccgggg
gaatgtgaagtggtcctcctgaatatgaccttcctggcccctgagtctctgggcagtgta
atccatctccaaaggcttctatcacaagtttggaggtggaggtggggtggggactctgga
tgaatttttagaatctggtccataaacttcccatttcattgggcagcatctggacaga
ttggaatgatgcaggatccgggtccaggccagtcattccctcacatgagctcatgttgac
atccctgacttaagagaacatcagaggcttacttctgactgtgccttcccacaggggaga
tgccaggtcaggttctgtacctggagtttgggggtggcccttcttaggggccatgctgta
aacccactcataaggtaccctgagttctaggcagcaggtcagacaagctgcagattctat
ggcttctccagctctcccgaaagttctttaaggaagccctcagatttccttttcccctgt
aatgccttggtccttggagattgctgtattgctgagacccatcatgctggaataccaa
gtcataaggcagtcacagggtctggaagccctcttcaggg >IGR3161a
tgagttctaggcagcaggtcagacaagctgcagattctatgcttctccagctctcccga
aagttctttaaggaagccctcagatttccttttcccctgtaatggccttggtccttggag
attgctgtattgctgagacccatcatgctggaataccaagtcataaggcagtcacaggg
tctggaagccctcttcagggtgggatgtgtggtggccaggtcacacatcaccctgccc
tagtggccttcacgtatttactgcacacccatcaggtgtctgtgctgctgggaataatca
gactgcttatttcatgcattcttcttctctgcataagtacgtattgagtactcagggatg
ggtccaggtatcatccataagggcagaggctgtgtctgtcttatttatttgtgtctctcc
agcacccgcagagaacttggcacacacaaggcattaaaaaacatttgctattaacaaca

TABLE 5-continued ccacagttacaggaattattatcttagcttacccttggacatgacccagagggacgcag
ggagggcataaggggcttaggaaggtgaagaattctgcttctgttgccttcgaggccac
acccagtggctcagggcacgatgcccaggccttctgtatgcagccaggtctgtccaaggt
caggagaagtcactgtgctctttcctcaatgggcaggcag >IGR3162a
atcttagcttacccttggacatgacccagagggacgcagggagggcataagggggctta
ggaaggtgaagaattctgcttctgttgccttcgaggccacacccagtggctcagggcacg
atgcccaggccttctgtatgcagccaggtctgtccaaggtcaggagaagtcactgtgctc
tttcctcaatgggcaggcagggctggcaggctccagcaggagcagacacccttgggaatg
ctgttgggcctgagcctagaataagagggaaggattgggacaagaacaacctcaggctaa
gggtgaggtcaacctggaggacaatccaggagagtgcccagaattgatgtagccctgagt
ggggaggtgcggtggagctgatgaggcagcccatatttgaggataccttcccgtgaggcc
ctgggggctagccagagagctcagctgctgacccgctcctccctggcctggtggcctcag
gtctctaggtagagtctgctccattctggctcagctcctggaggccaagacatctctcct
tcaaggcccagcccctctccccagccaagagcctggattccaaggggatctaaagcctt
gcttgggagttccatcttcctggaatgcccagtccacagtactgaccactccagggcctc
agcaaacagccagagagaactttagatgccttcatttcag >IGR3163a
ccattctggctcagctcctggaggccaagacatctctccttcaaggcccagcccctctc
cccagccaagagcctggattccaaggggatctaaagccttgcttgggagttccatcttcc
tggaatgcccagtccacagtactgaccactccagggcctcagcaaacagccagagagaac
tttagatgccttcatttcagtgtgacctgtctggtccagctccacccagatgtctgctct
cttagaagcctgctggtcaaggccaggaactcgaatggtggagggaagcagtctgtggt
gggcacagctggatagaggggcagcgtgggtctcctgcagggctagaactgcgccttag
agtgacaggagttaaggcaggcccactgtaggcagggtcaagggctctgcaaggggta
gaggcagccacaggcatgggcaccaggcaacatccaaaggaaggtctgagacagtacag
cctgtgaggtgggctgggggctgatgcccagcatatcctggaaggacaggactcagtcag
gaggcaacaaaactggtcctgagccgtggttggttcagcagaacacacaggggagggcg
tgcctgtggcaaagggcgtttcccagctctagttttgtgccattcaatccctcaacaaac
acttattgagtgcctgctctatgtccagcccagacctggt >IGR3164a
ctgatgcccagcatatcctggaaggacaggactcagtcaggaggcaacaaaactggtcct
ggagccgtggttggttcagcagaacacacaggggagggcgtgcctgtggcaaagggcgtt
tcccagctctagttttgtgccattcaatccctcaacaaacacttattgagtgcctgctct
atgtccagcccagacctggtcaactaaccttggagtgtggtggggattctccaagctgcc
acacctctctagggctgagatgctggaggctccagaggggtcagtctctgaggatcca
aacagggacaaagctggctctgccaactgggacccagttactggccctgagccagattcc
agggcggacacaagagcagaaccaactctcttcaggaaactgagcctgggggaggtgtgt
gaccaccacacgctcacacagtttcaagtggtaggtctgggtttagaccctgtgttgg
tgcctttgtgccatgtgccttgccccagggacagatgtgtctcagctggacctgcagtcc
ccatcagcacccctgtcagacctgctctttctctgttttcacagagaaaaccagtctgct
ctgggacccaacaaaggggttgccaggcagcagggcggggacaggtttacctagctgggc
ccagagaggccctggccctgaggcctgggtgtagaaaggt >IGR3165a
tgccccaggacagatgtgtctcagctggacctgcagtccccatcagcacccctgtcaga
cctgctctttctctgttttcacagagaaaaccagtctgctctgggacccaacaaaggggt
tgccaggcagcagggcggggacaggtttacctagctgggcccagagaggccctggccctg
aggcctgggtgtagaaaggtgttgggaggagtggcatctcacacggtgggggtgggggg
gtgggaggggaaggcagctgacaggtgggagagccagaggtggctcagcgcagcccag
cagggaagtgacagaacaggctgtttgtggtggcagcgaggcccatgtgatggaccttg
tgcaactggggcctcaggaaggcagcttgcaaaagcatcacagcctcacctctgcctcaa
ggagaccccatcctttcacccctcccacttctcattcaggccgaggattcgggcagcc
tgccggccatccccttagtctccccagcatcagatgtcccaagtctacctgtagtccata
aatagaggcccaacccaggtgtcttcaggtttccagtttctcctgacagctggagccttc
ccttagtcttgcctcttggtgtctgtgaggagaaggtgcctccatttacaaatcagctcc
tccaggcagagcagcagagggattgcagagcaactgtacc >IGR3166a
cccccagcatcagatgtcccaagtctacctgtagtccataaatagaggcccaacccaggt
gtcttcaggtttccagtttctcctgacagctggagccttcccttagtcttgcctcttggt
gtctgtgaggagaaggtgcctccatttacaaatcagctcctccaggcagagcagcagagg
gattgcagagcaactgtaccatgtgctcattctacgccctggacctagaatgtcttggcc
gtggcctgaccatcactgtgcctggacaaaagcaggggtgtaaaaacctttccttctcag
cccgagagagagagacgctgctataaggtgcaggtaaggcttgagcaaaagtgcagggtt
gacaagaaggagacggacatacatgcagcccagaaattcagttactgggctctccagac
atactctgtcactcatctgtcagctggggcctggactcatggcccagctttagccctgcc
ccagcgcacacatccacagacactcaaatttagcagtgacctggccaggactgtctggtc
tctggcctgagcccctccttctcttcttgaccactagaactgacatccagggctactca
gaaggcaggagaggcccatgctacttccatatttcttcctcccatccttctttttttttt
tttttaatagcagctagaacgagcttggagcactttcata >IGR3167a
cactcaaatttagcagtgacctggccaggactgtctggtctctggcctgagcccctcct
tctcttcttgaccactagaactgacatccagggctactcagaaggcaggagaggcccatg
ctacttccatatttcttcctcccatccttctttttttttttttttaatagcagctagaac TABLE 5-continued gagcttggagcactttcatatttctacgttcccaataaaataaaaaaggaagaaatgtga
aaatagtgtttcaagaattatggcatttgttacttctgctttgtttatttattcatcaga
tattttttgagagcctccatatgtgtcaggcactgttttaggcctcagtgttaaactattaa
gttttatttatttatttacttatttatttattgttattatcttttaaaaagagacgggt
ctcactatgttgtccaggctggtctcaaactcctgggctcaagcaatccaaccaccttgg
cctcccaaaatgctgggattacaggcatgagccactgtgccaggccttaagtctttataa
tacatatttaaaatggatagcctcatttggaaataacttcaaagatttaaattccagtct
tcctggttcttcgtctcaggagggaccccataactcctgatgcccatgattttctcact
ggtatagattagacctctgtctcttgatcctgagggtcc >IGR3168a
acaggcatgagccactgtgccaggccttaagtctttataatacatatttaaaatggatag
cctcatttggaaataacttcaaagatttaaattccagtcttcctggttcttcgtctcagg
agggaccccataactcctgatgcccatgattttctcactggtatagattagacctctgt
ctcttgatcctgagggtcctgggggctgtgattcagattggcagaggtggtgaagctct
cctcaggagtctggctagcataggcctgtcgctagcctatcctccctgccccatccttc
tatctcttacgattggccctctcccctgcagtgccagctcctttagtcactgattggtct
tggtgaagtgcctgccccgtggtgcccagcactgcccagtggtgactgagtcacaggct
ggcggggactgttcaggctgacctcacctccaggcctggccataggacgccagctgtggc
cactgggtatgagcctggccgcctgtgttgctgggagagtcaggcagagccatgtcgccg
agtccagtagctgccagctggccgagaggtctgggaatccaggtgcaggggccataggg
attaaagtcggaagagccagatccaggcctgtgagggtgaagctgggctgaggttgctgg
aggctcttgagagaatggattggagcagggcccatgagtc >IGR3169a
gcctgtgttgctgggagagtcaggcagagccatgtcgccgagtccagtagctgccagctg
gccgagaggtctgggaatccaggtgcaggggccataggattaaagtcggaagagccag
atccaggcctgtgagggtgaagctgggctgaggttgctggaggctcttgagagaatggat
tggagcagggcccatgagtcagcctcatgtcctgggtggctattttcttggcttctaaga
aaatcaaaattctttctcacttcccctcccaagactaggtccatagctgtgtagattcag
gatcagcagtgtggagttggaggcagagctttcatgggagtgggactgaaatcctcaca
ccctgcatctctcatacccaccgcaatggtaagagcattcacaggacttgagcttccag
caagaggatgcctgatcaaattgtttgccccctgtgaaatcaccatattaatgggaagat
aggcttgcttaggaacaacggagtttgtgcctctcctgcaggagaaaccaggagctctaa
gagaatgtataatgagaacttctatgtgtggagagttaaacaagaagctgtctcatccca
gggaagatgaacagaaatggcggatctgggcttgaagtgcacacagtgttggaaaaggc
cccacctaaggctctaggaccagcagtccctgagaagtag >IGR3170a
gagtttgtgcctctcctgcaggagaaaccaggagctctaagagaatgtataatgagaact
tctatgtgtggagagttaaacaagaagctgtctcatcccagggaagatgaacagaaatg
gcggatctgggcttgaagtgcacacagtgttggaaaaggcccccacctaaggctctaggac
cagcagtccctgagaagtagctgtgtgtaggattaagacaagctgactgcggagagctgt
gacattgggcattcaagcatgaagcattgttggcccagagagggtgcacaagcattctcc
ctcagagaaccatggtgttccagagccagagagagatggagagcttccacaatccttgtg
aagatctgttatcctaacaccaatatatcccctttaagaaatggtggcccccctgtaaat
tgtcaatatagcaaattggctcccataatatattgaaacactattaccaccttgggattt
cttttcaaattacaagcttgatttaatataaaacgtaatgattaatacattagattaaa
agaagaaaggaatcttgtaattatctcaaaaggcattgacaaaattcatcagccattcac
acgataaaagttagaaaaccatgaagagaggaaatgttcttcacattttaaagaacagat
ataaaaaaccaaaagccagcattagatttaacagtctaga >IGR3171a
gatttaatataaaacgtaatgattaatacattagattaaaagaagaaaggaatcttgtaa
ttatctcaaaaggcattgacaaaattcatcagccattcacacgataaaagttagaaaacc
atgaagagaggaaatgttcttcacattttaaagaacagatataaaaaaccaaaagccagc
attagatttaacagtctagaaagttctattaatgggagaatccaatgtcctcttcactac
tgttgttcagtgttgctctggaagtcctaaccaggacaataggggtgaaaagaagaaataa
gggagaagtaaaggaagtaagtaatagagtcaaaatgatcattatttgcagatatattatga
ttttcctttcataatatccaagagaatcaattgaaaaatgattatgaccagtaggagaat
ccagtaggagggagcagagtagaataaattaatatatgtatatagattttaatagcttt
aagagtgctaagtcacaactgattggaaaatgtgatgaaaacaatttaccattcacgata
atggtgaaacattaaaaatatctataaatgaattttgagtacatcaaaagcctataaact
cttttctttttttatttccttttctttatactagtggtggtgagaacanagggcctatgaa
ctttgatctatgatatatttaaaagaagacaanangtgtg >IGR3172a
gattggaaaatgtgatgaaaacaatttaccattcacgataatggtgaaacattaaaaata
tctataaatgaattttgagtacatcaaaagcctataaactcttttctttttttatttcctt
tttcttatactagtggtggtgagaacanagggcctatgaactttgatctatgatatattt
aaaagaagacaanangtgtgcacgcgtatgtcatgtgtctataaaaatcantattttaa
tttattagtaaattcaatgcaattccaaacaaaatttgtgtggggggggaggaattgacaa
gatgattctaaggatcaactgaaaagtaagtatgaaaaaaacccacaaatattggattaa
gagactaataaagtaagatttgccctataagaaagtatgcaatagagctaaaataattaa
gaatgtgatagcagcataggaaaagacgaatatgttagtggaacaaaagagagtccatag
catgagataaagaaaacatttaattcagggaataaaaggtagtttactcaataactcat
gttgggggccatttactattatgcataaaaaataaggctataattctatatgctatataat
ttcccacattataaagtaaatcccaaatggattcatgatctatatattttaattttccca
atgtgaatgcttttataaactactcatatgctttaccaga TABLE 5-continued >IGR3173a
ttaattcagggaataaaaggtagtttactcaataactcatgttggggccatttactatta
tgcataaaaaataaggctataattctatatgctatataatttcccacattataaagtaaa
tcccaaatggattcatgatctatatattttaattttcccaatgtgaatgcttttataaac
tactcatatgctttaccagaaatgactggtaaaaaaatatatagattaatattttttataa
tcatggtgctacggtttgaatgtgtccccagagttcatgtgttggaaacttaatctaca
atgcaacagtgttgagaggtgggctcttacgaggtgataaggtcatgagggctctgcccc
caatggattaatgccaacagaggtgggtttgttattgtgggaatgtgtccttgtgaagga
ggagctcggtccccctttgtctctcaccctctagccttctgccatggaataatgcagc
aagaaggcccttgaaagatgctggcaccttgatattggacttctcagcttccagaatttt
gagaaataaatttcttttctttataaattactcagctattggtattctgttatagtaact
tgaagcagactaagacttgaggtgagaaacatctctttcgtgaagataaatacttgaaat
atgttttcctgttacatatagatttcaaaaatcagagaaa >IGR3174a
ctggcaccttgatattggacttctcagcttccagaattttgagaaataaatttcttttct
ttataaattactcagctattggtattctgttatagtaacttgaagcagactaagacttga
ggtgagaaacatctctttcgtgaagataaatacttgaaatatgttttcctgttacatata
gatttcaaaaatcagagaaatatgctgcaaactgttggtagttttttgtttctgggatgg
tattttgggacatttacttttttctgagtttatatatttgtacagtgttttaatttcatata
aataaattttactgtttgtaattagaaaaatgaagataataaaaaggaaaataaagacaa
cagaaggacaaatactgcttcttatgtaagaaccttacaataatacacttccatttactt
ctcccttcttttttgctaatgttgttgtgcgtttacctctgtatttgctataaactccat
aataaatactcattattttttgcttaaacagtcaactgtcttttaagtaatttaaaaaac
aagaaaacctattttctatttacttgttaggtttactggtagcacttgttcttttgttta
gagctgaatttccaacaggtatcaatgagccacctcagcagagaaatggcttatttccct
tcagccttaagaacttcctttaggccatgtgcggtggctc >IGR3175a
gctttaaacagtcaactgtcttttaagtaatttaaaaaacaagaaaacctattttctatt
tacttgttaggtttactggtagcacttgttcttttgtttagagctgaatttccaacaggt
atcaatgagccacctcagcagagaaatggcttatttccctcagccttaagaacttcctt
taggccatgtgcggtggctcatgcctgtaattctagcactttgggaagccgagacagacg
gattgcctgagctcaggagttccagaccagcctaggcaacaacagtgaaaccctgtctct
actaaaatacaaaaaattagccgggcatggtggcgtgcgcctgtagccccagctactcag
gtggctgaggcaagagaatcgcttgaacccaggaggcagaggttgcagtgagctgagatc
gcaccactgcactccagcctagggaaacagagtgagactccgtctctggaaaaaaaaaaa
gaaagaaaaaaagaacttcctttaacatttccggtagtacagacggactggtgatgaat
tctgtcagcattttttaagatcccgaagtatttttattttcattccccaccctgtccc
ccaaccttttttttttttttttttttttttggagacagagccttgctctatcccccag
gctggagtgcagtggcacgatcttggctcactacaacctc >IGR3176a
ctttaacatttccggtagtacagacggactggtgatgaattctgtcagcattttttaag
atcccgaagtatttttattttcattccccaccctgtccccaaccttttttttttttttt
tttttttttttttggagacagagccttgctctatcccccaggctggagtgcagtggcacga
tcttggctcactacaacctctgactcccgagttcaggtgattttcatgcctcagcctccc
tagtagctgggattacagacacctgccaccacgcccagctaattttttgtatttttagtag
agacgggggttttgtcatgttggccagacttgtctggaactcctgacctcagctgttccat
ccgcctcaggctcccaaagggctgagattacaggtgtgagccaccgtgcccagcctctca
ttcccctttaaagataacttctctggatatagaatactaggttgcttttttttctcata
gattatttaatatttaatatatataattcctataattttattgttttctgtcttgcattact
cctggtaagaaataaatggtgattctaatcgttgtttcccttatgtaatgtgcctatatt
cttttatcacttctaagatgttctatttggttttaagattttgactatgatgttcctaga
tgtagttcccttgttttatcttctttggagttttaaaac >IGR3177a
ataattcctataattttattgttttctgtcttgcattactcctggtaagaaataaatggt
gattctaatcgttgtttcccttatgtaatgtgcctatattcttttatcacttctaagatg
ttctatttggttttaagattttgactatgatgttcctagatgtagttcccttgttttat
cttctttggagttttaaaacccccagcttctttgggatggtgtattaataattttttaaaatc
aaatatagaatttcatttaccatttaaaagaattttttttgccccaatctctttctcccc
tttccttctgggactccaatttatgtatatattagattacatgatactgtttcaaggtc
actttgttgaggctgtgtttgtattttcagtccttttacttttagatgttttccatagt
cttgacttcaagttcattgatctttcatttgtagcatccagtctactcataagtttatc
tagtacattttccattttgtatattgtattttcaattctagaattttcattcagctcct
ttttatagttttcatttctctgctgagatagctcatctgttcatttattatctctatct
tgtaatttaaacttcttaacatatttataatagctatttaaagtcctcatctgctagtt
ccaatatctgtgttacctctggatctatttctgttgatta >IGR3178a
atattgtattttcaattctagaattttcattcagctcctttttatagttttcatttct
ctgctgagatagctcatctgttcatttattatctctatcttgtaatttaaacttcttttaa
catatttataatagctatttaaagtcctcatctgctagttccaatatctgtgttacctct
ggatctatttctgttgattatttttttgtcctggttatgaatcatattttcctgcttcttc
atatgttagtaatgtttgactgtatattaggaattgtgaatactcattgttaagagtt
tggatcatgtttaagagtgttgagtttgttttattagatagtaaattcactagaggctc
aatttgagcctgaggcttggttttaggcttttattatggcaggtctaagatactgcgtatt TABLE 5-continued acaggcacagagtagccctattcttaaagcgtggactttcttgggttttcattgagtgct
cagggtgttcaacaaagtcttttcaccttgttgatcagaacagatctcagaatcatgagc
cctctagaatccccacttagttcttagacccagagaagttttttttgtgtgttttttgtt
tgtttgtttgtttggttgttgtttttaatccactaggccttatggaatcttgctctgcat
gtgaggcttagacaaagcctcaggagcacctctgtatagc >IGR3179a
tttcaccttgttgatcagaacagatctcagaatcatgagccctctagaatccccacttag
ttcttagacccagagaagttttttttgtgtgtttttgtttgtttgtttgtttggttgtt
gttttaatccactaggccttatggaatcttgctctgcatgtgaggcttagacaaagcct
caggagcacctctgtatagctttcagagctccttctttgtgtagctccttcttctttga
tacttatcccacaaatttcagccacctcagcgtctgctatctatgatctttgtctcctt
cacatgatgagaccattgttctctctctctctctctcttggagacagggtctcactctg
ttgcccaggctggaatgcagtggcacgattatggctcactgcagcctcaacctcctggcc
tcaagtgatccttctgcctaagcctctggagtaactggtactacaagtgtgcaccacaat
gcctggctaatttttttaacttttgtagagacagggtattgctatgttgcccaagctggtc
tcaaactcctggcctcaagggatcctcccacctcagcctcccaaagtgctaggattacag
acatgagccactgtgcctggtgccattgctttctgggcaccacttccttatgccatggtt
tggaaagtatcctaggcaaagcacttcccttttgtttcc >IGR3180a
tttgtagagacagggtattgctatgttgcccaagctggtctcaaactcctggcctcaagg
gatcctcccacctcagcctcccaaagtgctaggattacagacatgagccactgtgcctgg
tgccattgctttctgggcaccacttccttatgccatggtttggaaagtatcctaggcaaa
gcacttcccttttgttccctctcaaggacaaaggctatttgatgttcaatgccta
taatcactggctataaatatttcgagttttatggttgtttacagtggggagggaagttta
ttaccaacttatcagttatggttggaacctaaggaaagtttgaaaactaaaagaagaaag
aaaaggaaaagaaaatagggacccttaattcaagatgtggatctgatgtcataaatgtct
aagagtctgagcttcatctcaaagcagctgggccagttggacataccctgctgtagttct
ttctaacctggcatcagaattggactgaataaaatgtacagttctggccactatagcagg
ttgtgtcagacttatccttctgctgaaaacaactataaaagttggacaaaatgtataaaa
caactatttgaaggcatttgagaacaaccaatacagctaagaattgaggagttgtgatcc
tggagaaaagggaataatgtgtagtgagttccacatttac >IGR3181a
tggactgaataaaatgtacagttctggccactatagcaggttgtgtcagacttatccttc
tgctgaaaacaactataaaagttggacaaaatgtataaaacaactatttgaaggcatttg
agaacaaccaatacagctaagaattgaggagttgtgatcctggagaaaagggaataatgt
gtagtgagttccacatttacctttgcttttccctaggggcatttcacacattgttactt
gagggaatagggaccaggcagaaagcatcagtcttaccagactgaggatacaaaggtcag
agttcagggctgccgaagaagatggaaattaagaaggaaaattccagaaggtaggaaaga
agagaaggagcccaataattgcatgcaaattcctccaactttattggctttttttttga
gacagggtcttgctttgttgcccaggctggagtgtagtggtgtgatcttggctcactgca
gcctccctcaacctcctggattcaagccatccttccacgtcagcctcccaagtagctggg
actacaggcacatgcaatcatgcctggctgactttgcttatttttttgtggagatgaggt
ctcactatgttgcccaggctgggcttgaactcctgggctcaagcaatactccagcctggg
tctcctaaagtgttgggattacaggcatgaatcaccatgc >IGR3182a
ttcaagccatccttccacgtcagcctcccaagtagctgggactacaggcacatgcaatca
tgcctggctgactttgcttatttttttgtggagatgaggtctcactatgttgcccaggct
gggcttgaactcctgggctcaagcaatactccagcctgggtctcctaaagtgttgggatt
acaggcatgaatcaccatgcccacccctattggcctacttttagcctatcaggctaaagaa
ctgagcaaattgtagtagtcttaaagtgttggggagacaaattggaattcaacttctatc
aaggtagagaggccttggtaaatgcgtaggtgttctgctaagtcccagaagggtcacaca
ctaggagagaggtcacatcctaggaataagagatatgtcctaggacaaaaaaagaaccac
accagccaaaccatgacataaaccaaagccttgacaggagtagggtatttatttggtact
ctgccttccagaagtcaacttaattctctcttttctggatgaatacaacatcacccagaga
ctttccaacttttcatccaaaatgtgtgtcatctaatagagaagtatgagacatgctaaa
aaacaaaacaaaacncaaacaaaaaaacagggccaaatgactaaaaatcaagagaaaagg
cagacaatggaaatagacccacaggtgtttcagaaatgag >IGR3183a
taattctctctttctggatgaatacaacatcacccagagactttccaacttttcatccaa
aatgtgtgtcatctaatagagaagtatgagacatgctaaaaaacaaaacaaaacncaaac
aaaaaaacagggccaaatgactaaaaatcaagagaaaaggcagacaatggaaatagaccc
acaggtgtttcagaaatgagagacttccaataattatgatgaaaatgttcaagaaaatag
agggaaagtaaaaaaaaaaaaagatgaaaagctagagaatttaaatatagaattgccag
aatactgataaagatagcagataggaggcaggactagcttgcagctcctgctcagacaaa
cagagcagtgtgtggagactcacatcctgaacttttgctccaagaactactgcaggaaca
taccaggaaagccaagagaatccacagacccttgaaggaactggatcactactgcaggc
tcctcgagatgcaaaaaaactgtgagtctgcatgtttctcagcagggagggtcatggtc
tgggacaagttctcagccctgggcactggctacctggaaatagactcagtactgttgtgg
ggccatggtgggagtgagattggcctttaggactgtgggttgcacaggagcagggtgagg
cctgtgactgccagcttctcccacttccctggcaaacct >IGR3184a
tgtgagtctgcatgttttctcagcagggagggtcatggtctgggacaagttctcagccct
gggcactggctacctggaaatagactcagtactgttgtggggccatggtgggagtgagat TABLE 5-continued tggcctttaggactgtgggttgcacaggagcagggtgaggcctgtgactgccagctttct
cccacttccctggcaaacctgtatgactcagcagaggcagccacaatcaccccccgggagt
ataactccatcggactgggaacaacacccctatccccacagcagctgcagcaagccctg
gccaaagagaggctgagctctgaaatgcatatccctgcccccacctgatggtctttctct
acccaccctggtagccaaagacaaaggtcataatctcttgggagctctatggccctgccc
accgtcttaaccaggtgtccctagggcaaatttgcattctccttataggactgcagcaga
tgtgctcttgaaagcaccacctcctgcatggaggccaaccaacacaaaaccaagtaccct
cacagagtccatttcactcccctgctacctccacaggagcaggtgctggtatccatggct
gcaatacctgaagatggatcatatcacaggactctgcagacactccccagtaccagcctg
tagcccagtagctcagctaggtggctagacccagaagagc >IGR3185a
ctcctgcatggaggccaaccaacacaaaaccaagtaccctcacagagtccatttcactcc
cctgctacctccacaggagcaggtgctggtatccatggctgcaatacctgaagatggatc
atatcacaggactctgcagacactccccagtaccagcctgtagcccagtagctcagctag
gtggctagacccagaagagcaaaaacaatctctacagttcagctctcaggaagccccatt
cctaggggaaggggggagaacaccacatcaagggaacaccccatgggacaaaataatctaa
acaacagcccttgaattccagacctgccctctgacatagtctacctaaatgagaaagaac
cagaaaaacaattccagtaatatgacaaaacaaggttctttaacaccccaaaagatcat
accagctcaccagcaatggatccaaaccaagacaaaatctctgaattgccagaaaaagaa
ttcagaaggtcgattattaaattaatcaaggaggtaccagagaaaagtgaagtcctactt
aaataaatcaaaaacatgatacaggatttgaaaggaatagtgtcaataggggatggtagca
gttcttctttgaatgtctgatagaattccacagtgaatccacctggtcatggattttttg
ttgttgttggcaattttttttttttttttttttttaagag >IGR3186a
attaatcaaggaggtaccagagaaaagtgaagtcctacttaaataaatcaaaaacatgat
acaggatttgaaaggaatagtgtcaataggggatggtagcagttcttctttgaatgtctga
tagaattccacagtgaatccacctggtcatggattttttgttgttgttggcaatttttt
ttttttttttttttttaagagatggagtctcgctctgtcacccaggctggagtgcagtggt
atgaccttggctcgctgcaacctccgcctcccaggttcaagcaattctcctgcctcagcc
tcccgagtagctgggactataggcgcccgccaccatgcccagcgaatttcttttgtattt
tagtagagacgggggttttcaccatgttgcccaggctggtctcgaactcctgagctcaggca
atccgcccaccttggcttcccaaagtgctaggattataggcgtgagccaccgtgcccagc
cagcaattttttaaaattaccattaaatctcactgcttgttatcggtctgttgagagatt
ctatatcttcctagtttaatctaggagggttgtatatttccaggaacttaaccatctcct
ctaggttttctagtttatgcatgtaaggtcttcatagtagccttgaataatcttttgtat
ttctgtggtattgaagtggcttcattgtctggggaaatac >IGR3187a
atttaaatctcactgcttgttatcggtctgttgagagattctatatcttcctagtttaat
ctaggagggttgtatatttccaggaacttaaccatctcctctaggttttctagtttatgc
atgtaaggtcttcatagtagccttgaataatcttttgtatttctgtggtattgaagtggc
ttcattgtctggggaaatacccctaggttcgtcttgcactgagaagattaacaacacagac
acacacgtgaagcaggttaaggaggggaaagtttaatagacaaaaaagaagagagagt
gagctttctcatacagggcaggtgggatgcgatccattttatagagaggcttgaggaggc
ggtgtttgatttacacaggggccaggggattggtttgaccaggtgtaaatggttacatag
cccgagaagaaattggccatcccaccttaatcttttattatgtaaatgtgacctctacct
gtccggtgccatttgaaccttgattcctcattgtaccacacataaaattaatttaagatg
gatcatagactgaactatgaaacaatcaagcttctaaaggaaaccatggaagcatagttt
catgacctctgggtagggaaacatttcttaaatgggacatagaaagcactagccaaaata
taaaagattaatatgttggatttgtaagaattaagaactt >IGR3188a
tgattcctcattgtaccacacataaaattaatttaagatggatcatagactgaactatga
aacaatcaagcttctaaaggaaaccatggaagcatagtttcatgacctctgggtagggaa
acatttcttaaatgggacatagaaagcactagccaaaatataaaagattaatatgttgga
tttgtaagaattaagaactttttatttatcaaaagatcctattaggagaatgaacaagcca
aagcacagattgagagggaatatttgcaatacatatatccaacaacaaactcatatggag
aaaatatatagacttctacaattcagtgaggaaaatgcagaaatcccataggaaaatgg
acaaggacttgaacagtcatgtcacaagaaataactaataaacacctaaaaagatgctca
atatcaccagggaaatgttcttttaaattgcaatgagatattgctacacacccaccaaaa
tgactgaaattggaaaagctaacaataacaaatgttgacaaagatatgaagcaactggaa
ctctcattcattgccattgggaatgtaattttgttcatccatttagaaaaatggtaatat
ctacaatagctcaatatatgcatgtcttatgacctagggattcactcctggattttttat
tatatttaaataagtgcttgtgcccaccaaaagacatgtg >IGR3189a
aacaataacaaatgttgacaaagatatgaagcaactggaactctcattcattgccattgg
gaatgtaattttgttcatccatttagaaaaatggtaatatctacaatagctcaatatatg
catgtcttatgacctagggattcactcctggattttttattatttaaataagtgcttg
tgcccaccaaaagacatgtgcaaacatatacaaaacagttttatttaacatgactaaaaa
caacccaatgttcatcaacaaaaatgataaattgtgttatattcaaacaatggaatacc
acatagcaatgaaaagaatgaggaactattacaaacaagatagatggatatcacaacca
taatgtggagtataagaagccgacccgaaagaatatatattgtataacttcacttttata
aagttcaaaatctgacaaaactaatcaaaagtgaacaaagaaaaaatagtgcttaacttt
gggagagtttactgactatgaaaaggtacatggaagccctctggtattctggaaatagtc TABLE 5-continued tatattttatgtgggaggtaattatgtgaatttatatgtaagcaaaacacattgagctg
tatattcagacatgtttagtttactgtatgttaactgtatcttaataagtaagttttaa
acaaaagcacactggctgcccatgcctctctaccctgct >IGR3190a
aaaaggtacatggaagccctctggtattctggaaatagtctatattttatgtgggaggt
aattatgtgaatttatatgtaagcaaaacacattgagctgtatattcagacatgtttagt
ttactgtatgttaactgtatcttaataagtaagttttaaacaaaagcacactggctgcc
catgcctctctaccctgctagtggggattcgtgagcccgaagagggagatactattaa
tagctttccagtgtatagaagatgggctcatattcgcaccctagtttatggagcagggc
ataccaattgcaggtcacacatggaacccattcatgcattccttcttcctctctctgcat
gccactattggttcccaaatcaaagagggcttccagggtgacctgtgtgtttggccttg
ggggcttgtgacaataaactggggagatgcattagtgtgctaaggctgccataacaaaat
atcacagcctgagtggcttaaacaatagaaattcattttctcatagttctggaggccgga
agttcaagattaaggtgtcatcagggtgggttcctggtgaggcctctcttcctggcctgt
agatagatggccaccttcttgctatgtcctcacatggcctcatctttgtgcaaatgtgga
gagatacaactctcttgtctcttcctcttcttacaaggac >IGR3191a
aacaatagaaattcattttctcatagttctggaggccggaagttcaagattaaggtgtca
tcagggtgggttcctggtgaggcctctcttcctggcctgtagatagatggccaccttctt
gctatgtcctcacatggcctcatctttgtgcaaatgtggagagatacaactctcttgtct
cttcctcttcttacaaggacaccagtcctattcaagtaagtcttcaccctgcgacctca
cttagcctttatcagctttattaacctttttataggtcttatctccaaatgcagtcacat
ttaggtaagggcttcaacatatgaattttgaggctatgcaattcaatccacagaaggagc
tgatttacttttacacccatgtcaatttggcccctccaccccactgatctcagagcat
ttcctgggggtcacctcagtgtgttctgcaacaatcctctgcctctgagccagactgaca
gctctgccctgccacccattgctacttctgctgtccatggctctggaggcctctgctct
gctggaagtatcatctgtgtttgtcaccactggggagagatgctgtttactgttgataccc
cccagcccagtcccaatggtggtggggtgtatactctctcattaggcacttccctctact
tcctaaacacagcaaggcccagagagggatgaggccctgc >IGR3192a
gctacttctgctgtccatggctctggaggcctctgctctgctggaagtatcatctgtgt
ttgtcaccactggggagagatgctgtttactgttgataccccagcccagtcccaatggt
ggtgggggtgtatactctctcattaggcacttccctctacttcctaaacacagcaaggccc
agagagggatgaggccctgcctggccaccgtaggtctccgtgggaatgagccattccctc
tcccaggctttgctcattctatctcctctgctgcaataccattctcccagacctccaaca
cttcccctggctgactatgcagggagacccacacctcatcctcctacctgaccactcggc
aagtgagtctccccttctgtagtctccctcagcctctgcgattcaccgtcaatttcttca
tctgtgcctcctctccccccataaaacaaaacaaacaaacaaacaaacaaaaaacaacat
gagctccatgcaggcagggtgtttttctgactcatctctgtgtccctgggtacccaggac
tggacacaagggaggtgtcaggggatgtctgttgactgactgaatgtgagtaagtgaggg
tgtagagggttcctgaagcccctaggctgagtgaccaagtatggaaaccctgcttgccaca
cttcagcatgaccaaggcagctggtcttctccttcaaagg >IGR3193a
gtttttctgactcatctctgtgtccctgggtacccaggactggacacaagggaggtgtca
ggggatgtctgttgactgactgaatgtgagtaagtgagggtgtagagggttcctgaagcc
ctaggctgagtgaccaagtatggaaaccctgcttgccacacttcagcatgaccaaggcag
ctggtcttctccttcaaaggcagtgctgaggcttgacaggtcatagagccaggccttcat
gtctaggctgcagacagcttcctcaaagtccatctcctcttccctactgatcttttcctg
ctactccccattggttgaacccaaccagaagctgcagggcaggtgaacctgttgatgcta
tccatataggtcagcagtcagggcgcagagcagggaaagaggagacgaggaggagatc
tggaagggtaagcagatgacatctgtcaagtgttaggtaacacttggtacagggagagtg
ctccataaattagttgtccaatcacagaagcatcccagagcatcatagaaacccagatga
ggactgcccatcctgcttctctggctcttctcctccaggagctcctctccacagagccag
gatattctgggtatgttcagagttcaaggtctccccatctccttttcctaacttcactgca
ttactagtccttggtgtttccttagggctactggctccta >IGR3194a
atcacagaagcatcccagagcatcatagaaacccagatgaggactgcccatcctgcttct
ctggctcttctcctccaggagctcctctccacagagccaggatattctgggtatgttcag
agttcaaggtctccccatctccttttcctaacttcactgcattactagtccttggtgtttc
cttagggctactggctcctatggcctgaggcttccacagcctgaggcttccaaggctac
aagtcaacttagctgaccatgaaggcccctgatcactatgggctgaggaaaggatctggg
gtcttcccaatatcctccctgcctcctcagccagtggaggtcccagcattggagtcattc
cccaggggcctggaaaacatctctcccttcccgttgctcatgattatgcaggcctagtcac
aggtctcagctaaaccttggcaggttggaaggatggggcaccaagtggaggggcttttttg
agcaaggctgggctgctcctttgagtgagccctgttgagctccatgcaccctctggtgg
ccaacctcattttttgcaactacagctctgtgaaaagaaggaagcagctcccctaaaaagat
tctcccagaaggcctcacacaccttttgccctgggacaaaaatagctgttggtgccccagg
agagagtgcagagaaaattccagaacttgatgagggcagg >IGR3195a
tttgagtgagccctgttgagctccatgcaccctctggtggccaacctcattttttgcaact
acagctctggacaagaaggaagcagctcccctaaaaagattctcccagaaggcctcacac
accttttgccctgggacaaaaatagctgttggtgccccaggagagagtgcagagaaaattc
cagaacttgatgagggcagggtgtcaacctggcctacagctgttgggtgaccactggtgt TABLE 5-continued caacctggcctacagctgttgggtgaccactgggtgagagggcagtacttgcccccaaa
attgcagccaccaatgacagcatctaacgacccagccagtttgaggaagccatctttcca
ccttcaccaccttgatcattcactcttcagccaagaagatgtactgtccaagccatccct
tctcccatgggctctgatttctacagatgatagaggtagacatcttcctgattccaagtc
tgcaactagctggttcagggtcagagtaagtaataaggccagagcctggtccaaagtcaa
tatcaggctctggttcagagtcaagattaagggcagagccagaggacaaaggacagaacc
tcctccttctcatgtgaaaggccagatccacacgcttgcgtatgcatgtgaatccctctg
tgcgtgagcatataaatgtgtgtgtgtgtgcgtatgtg >IGR3196a
tcagagtaagtaataaggccagagcctggtccaaagtcaatatcaggctctggttcagag
tcaagattaagggcagagccagaggacaaaggacagaacctcctccttctcatgtgaaag
gccagatccacacgcttgcgtatgcatgtgaatccctctgtgcgtgagcatataaatgtg
tgtgtgtgtgcgtatgtgtgtgtttgtgggtgagagccctcttactagaggctatg
gccaagttgctctgtttttcaggcactagaagctcagggattatcaagcttctcacaggt
ttatgcaaatgtttgaaacatgaaaaaaatatagaaagctataaaaaatgtaaatactaa
atatagtaaatgttaacagtatgtcatagtcatagtcaactgaagttcagccatgttctt
gtgtggtcaagtttaaaatgtatttatgtgggatgtgggtgtgtggaataggtttgatgt
ggaatgaggtagtcaggacctttggaggaatgagtgccctggcctccttgtggtgggtaa
gagtcccagggcagtgtactgcagggccacaaggcagggctgactagcaagttcaaatgc
tggtgtctactgaagggaaggggagatcagagctgcaactggagctgacactagcagggc
agttgagggcaggaaagaggccacaggagggtttagggtc >IGR3197a
tttggaggaatgagtgccctggcctccttgtggtgggtaagagtcccagggcagtgtact
gcagggccacaaggcagggctgactagcaagttcaaatgctggtgtctactgaagggaag
gggagatcagagctgcaactggagctgacactagcagggcagttgagggcaggaaagagg
ccacaggagggtttagggtccttgagacaggagtgagcaggcctcagccacaccagtgat
tcaggcttttgtgattatgtggtagcagactgggattagggctagccactgacagctcat
gtggtgatttttttttttttttttgagacggagtcttgctttgtcacccaggctggaac
gcagtgtcgtgatcttggctcactgcaggttctgcctcctgggttcaagcgattcttctg
cctcagcctcccgagcagctgggactacaggcatgcaccaccatgcccacctaatttttg
tattttagtagagatgagtttcgccatgttggccaggctggtctgcgtcttgaactcc
tgacctcatgatccacccaccttggcctcccaaagtgctggaattacagctgtgagccat
cgcgtctggccaatttttttttttaattagcaaaagatactccttttcaattcacttta
tttccatctactgaaaacttattgtaatgactatgcacat >IGR3198a
tttcgccatgttggccaggctggtctcggtcttgaactcctgacctcatgatccacccac
cttggcctcccaaagtgctggaattacagctgtgagccatcgcgtctggccaattttttt
ttttaattagcaaaagatactccttttcaattcactttattttccatctactgaaaactt
attgtaatgactatgcacatctatgatggctgccatgtaaatggagacatcattgtgcag
tgcaccaattgagcaatgtttgattgggctaggatcactcatggatagattcatggacac
cagtcttgctcctgaaaggatataaggtgccttacaaacaagtttcattatagcaaagtg
aagtacattcatttaaaaatagagagaggcagcctgggcaacatggcgagacctcgtctc
tataaaaataaaaaattggccacgtgtggtagcgtgtacctgtggtcccaccagag
aggctgaggtaggaagattgcttgagcctgggaggctgaggctgcagtgagcctctgaac
tccagcctgtgttcgtacactgcacttcagcctggagagagtgagacccaaaaaaaaaag
tgagtctcaaaaaaaagtgagtgagtctcaaaaaaaaaaaaagaaagaaagaaaaagg
agaggaagggtggcaccaggagagtttgtgctgaaactgt >IGR3199a
cttgagcctgggaggctgaggctgcagtgagcctctgaactccagcctgtgttcgtacac
tgcacttcagcctggagagagtgagacccaaaaaaaaaagtgagtctcaaaaaaaaagtg
agtgagtctcaaaaaaaaaaaaagaaagaaagaaaaaggagaggaagggtggcaccagg
agagtttgtgctgaaactgtcattaaatgtgtggttacctcgcaatgaaaggagtctcgt
atttgaggaagccagacactgtgattaggattccatgtcagcctgaaacccagaagagtg
ctggcgtgttctctggaggcagccaattttcactctctgttcttgtactttctgggggct
gccactaatttcctttagcaagggctgctctagggtaacagggctgaggggcttggatg
acaagtaggacctcatccctaaaagggagctcagaatggggggcagagcattcaacaaat
atttacagaatataatgaatgagcaaaggaacatagcccttcctactttacgtcaccaatt
cttaactatccacttctctctcta tattcattggcagttccagttcaggtcaccatcagct
gtcaccccgcctcagccaagctctgctcctccttctcccccactcacccacagtagaaag
ggtgttttcccaaatcccaaatcttatcctgcttctccc >IGR3200a
agcaaaggaacatagcccttcctactttacgtcaccaattcttaactatccacttctctc
tctattcattggcagttccagttcaggtcaccatcagctgtcaccccgcctcagccaag
ctctgctcctccttctcccccactcacccacagtagaaagggtgttttcccaaatccca
aatcttatcctgcttctcccctgcctttgctctggggtgtctgctccttgtcttcagcct
cacatccaaatcctttttgtggtccatgaggcctcaggtgatctgtccctgggatctct
gcagcttacctcttattactcccctactgtctgctccaccattgttccccaatcaagag
cttcagggtttggccttggaggcttgtgacaataaactggggagatgtattagtgtgct
aaggctgccataacaaaatatcacagcctgagtggcttaaacgatagaaattcatttctct
cgtagttctggaggccagaagtccaagattgaggtgtcatcagggcgggtacctgatgag
gcctgtcttcctggcttgtagatggtcaccttcttgctatgtcctcacatggcctcatct
ttgtgcaaatgtggagagatacaactctcttgtctctcctcttcttataaggacaccagt
cgtattcaagtaaggcttcacctctatgatctcacttaac TABLE 5-continued >IGR3201a
gtccaagattgaggtgtcatcagggcgggtacctgatgaggcctgtcttcctggcttgta
gatggtcaccttcttgctatgtcctcacatggcctcatctttgtgcaaatgtggagagat
acaactctcttgtctctcctcttcttataaggacaccagtcgtattcaagtaaggcttca
cctctatgatctcacttaacatttattagctttattaaactttttataggactaatctct
actggcttcctgacattttaacaaggcctgaaaaaaacattaaaaacactcaactttcag
ccttttagatagtagctacatcagatgcccaatagctatccttaaccctcaccttatcac
ctatccctaatccccacccagccccaatatagggtcaggactggggaaggaaggacgagt
ggctgctggactgtaataataattctaaaagtgtgctttacagtatatacatcaaaatat
cagatttcaagcaccatgcctagctaactcctgccctctggacatttgcactagtccaga
gcctctcgcccaggatggaggtgaagtgaggaggaaagttgtagtgtaaactcactcttt
acaccatggggggcctgccctggacttgctgtgtaattgcagttcctgaaggtcttggca
tgcctgtaatgacaactcagcctgattgctgactctgctt >IGR3202a
tagctaactcctgccctctggacatttgcactagtccagagcctctcgcccaggatggag
gtgaagtgaggaggaaagttgtagtgtaaactcactctttacaccatggggggcctgccc
tggacttgctgtgtaattgcagttcctgaaggtcttggcatgcctgtaatgacaactcag
cctgattgctgactctgcttgtcttgggttgcaggggtccatgggggaggcaaatggtag
gagagttgtagcctgctttggtttttgcacccaccagatgggtcagggattagggggc
actctctagggacacacttggtcctgcccagcctgtccccacaggcttctggggattctg
ccagattatctttccctttccagggtcaaccaccaggctataagaccagactactggat
aggccctatttcagaagcagtagggctactactaggtagccccactcaagccacaagtct
tgctgtctgtgtttggccttgagtcaaagcgccagccaactgagacacactcggtctttc
ctcagtctctaaggggagaaacctagggtgggttgagctccagtggacagctgcatgcgg
aatgtaccgaagaatacagatgtgtatccacatatacaatgccctctgtgtggcattggt
tgaacctgagggccttgctctgggaaattccatggaaggc >IGR3203a
gagtcaaagcgccagccaactgagacacactcggtctttcctcagtctctaaggggagaa
acctagggtgggttgagctccagtggacagctgcatgcggaatgtaccgaagaatacaga
tgtgtatccacatatacaatgccctctgtgtggcattggttgaacctgagggccttgctc
tgggaaattccatggaaggccagatagtcgtaaaccctgaccacacctccagctgctgca
gtggttccagggcctgcaagagtcatcagcattcagggagacttcagtgccaagcagtgg
agcttgccccactcccctccccaaaaacagggatcacaggtgagtaggagtggaggaggc
tggggcagggcaggctgagtaggcccctgtttagagttaagggctatgccacatccaccc
tcctattcatccaatttcctgtccgcccagcacagatgttttactatccctctgggga
aacaccaggttcttccttcggggtggggatggcaggcagacaagtccagactgcttcaag
gagccattggccagggatattgcctagggacagcatggaggtagagcctcatttggcaat
gccctggccatgctgggtgaaaggtcataggccatgcctgatcttgagcctaggaaggg
tctctaagactgggtctaggtaggcagtacctcctactag >IGR3204a
gggtggggatggcaggcagacaagtccagactgcttcaaggagccattggccagggatat
tgcctagggacagcatggaggtagagcctcatttggcaatgccctggccatgctgggtg
aaaggtcataggccatgcctgatcttgagcctaggaaggtcttaagactgggtctagg
taggcagtacctcctactagtagccttttcccagctggaaaggcttgggcttttccctccc
tagacaaagttgctgggcgggcctctgcttatctactagttttttatactagacagagccc
ctttgatatgtgtggtccctgaatcccccgccttgacctcaactggtgatcagcaaatgt
ttgttgagtgaacacataaatgaacaccatagagctgttccagaagggaggtatgccctt
gttcatacaatggatttggggagaagggatgtgaatctctataacatgctgtgatgtgtg
gctgttaaagatggtttgtggattcattaagtgacacacactgggtgtactcaatgaggtc
tgctagaggccacaatagtgggaatgtccactcattcattcatgtatttttgttcaccaa
ttcctctctaggctctgggcgccagacccatgctagagctggagacacagtgatgaaca
ggttagaggcagtccccaggagggccaaatggtaaatgaa >IGR3205a
attcattaagtgacacacactgggtgtactcaatgaggtctgctagaggccacaatagtg
ggaatgtccactcattcattcatgtatttttgttcaccaattcctctctaggctctgggc
gccagacccatgctagagctggagacacagtgatgaacaggttagaggcagtccccagg
agggccaaatggtaaatgaagtagacattgaatgaggtcaggtagcatgtgtgaaactca
tccatgaggagctttggggcctatggcaggatctggctcaggctagacccagaaagcctt
ttgaaagaaaccacctttttgggaagagaatgttctaggcaggaggaataacacattcaaa
ggccagggaactgaaaagtgcctgagtggctgcagcatcaagtttgaggctgtgcataa
gaagagagaccatcagggctggataaaagggattggcagcattggcaagatttgtgtcta
ccctgggtccatggaatacctttgagaggttctatacggaaataacatgatgggaatca
catggttacaatgtcactctgccctgtgtaatggagtaaggatagagggagcggagtaga
aaagtgggctaagatggattgtccaagtgagagatggtggtgtcctgaatttggtctgcg
acagcagggttgggaagaag >IGR3206a
ctttgagaggttctatacggaaataacatgatgggaatcacatggttacaatgtcactct
gccctgtgtaatggagtaaggatagagggagcggagtagaaaagtgggctaagatggatt
gtccaagtgagagatggtggtgtcctgaatttggtctgcgacagcagggttgggaagaag
taagtgaactgagagagatccaccaggtaagatctccagggtgggcatgcagtcggaaag
aaaagggaagtgactgggagatggtgatatttgctgagatgtaggaaatgctggggcaga
agcagtttgggtggtgtgggctgtggtatgggggagatgtttcatcctggctgaacctgc
agctggagatgcccaaaagcagtggcaggggggtccccatacgggactaccccaaacca
tcctgaaatggtttgggattccaaagaaagtagcactaaatgccagggtgatcagtccaaa TABLE 5-continued gcatttattagggaaatttctcggtctctgagggggctgcagtacatcctgtaggcagac
agcgagacaggatgttctatctaggtatgcctgctgcaaggggggtctgggtatggaat
ttatatgagattttaaggaatttggctcagggtcggggctagtttctttcagtgtttcgg
gcgaccatctaaacacctttatcagtgcctgggaatgttt >IGR3207a
tcggtctctgagggggctgcagtacatcctgtaggcagacagcgagacaggatgttcta
tctaggtatgcctgctgcaaggggggtctgggtatggaattttatatgagattttaaggaa
tttggctcagggtcggggctagtttctttcagtgtttcgggcgaccatctaaacacctttt
atcagtgcctgggaatgtttaaggccccagcttgggctcaagcctacaggaaaaaaccttt
cggctgtctgggtcatagagtggtcaaggcatttggtatttgtcaggagagagaaaaaag
tgagggaacctggggaccctacatgagacaatgagttcacttatcaagtggtcataaag
aaaaggctgtgacgatgtgggtctggagtggacccaggctggagattcaaaactgagtga
tagatttacatgggtccagaagcctttgagggcatggaggaatgtcaaatgtagtggatt
aaatggtgcccccaacccaccaaattgcattcatgtcctactacctggatcctgtgaa
tgtgaccttatttggaaaaatggaccttacagatattattaagttacaggttattaaggg
agctgttgcagtggttccagggcctgcaagagtcatcagcattcagggaggcttcagtgc
caaacctccctggattacctgggtagacctcccaatctgc >IGR3208a
accaaattgcattcatgtcctactacctggatcctgtgaatgtgaccttatttggaaaaa
tggaccttacagatattattaagttacaggttattaagggagctgttgcagtggttccag
ggcctgcaagagtcatcagcattcagggaggcttcagtgccaaacctccctggattacct
gggtagacctcccaatctgccctggattacctgggtagacgctacagccaatgacagtta
tttttataagaaacagaagggcagaagatgcagacaccgaggagaagtgcaggtgaagat
ggggcagagattcgtgtgatacagccacaagccaaggaactcctaagccaccaggagctg
gaagaggcaaggaggggttcgcccctagagccttcagagggagcacaccccggtaacatt
ttgattttggacttctggcctccagaactgtgagagaataaaattctgttgacttaaggc
acctagttcgtggtaatttgttgtggcaacccccaggaaatgaatagatcaggagcccaga
tggagtctgagggcctatgttaagggctgagtggtgaaagtgaggctacaaaggcagag
gtcagaaatggtatcttctgggtggaggcaggtagaggaaaaggaatataaaaacaaatg
aatggccacttcctgcaaggcaggaagaccaaggagacat >IGR1350a
gaaatcgaggagtttccgggaaccgaaccacgctgggagcgctgaggtctgcgcagcggc
gggggccggggacgggcgggcgtccagtgttaccggccagtggccagctggaagttcca
gcgggagccgggaaaaccggccccggaaaagcccaccctgaatgcacctgcccaggcct
ctccggatggtgttcatgctgagggtgggggtgtgaaggatggacctgcctgcagggtgg
cctttagggaatgagggaggagttctacaagctaaggggtttgaggtgtgcacgcgggg
aaagaggggactgtgcgcaggcaggtgggatctgaggaattgggatatcccctcaaatga
ctgaggtccccagctgtccctcactgtcacatcccatcttattgtccttatacgatgag
gtctccttactgagatcatatccgtagtgtcctcttttgcttatttgttggaggatttcc
ccgaacatgacttggagcccttgagagtgagccctgactgtctggtctagtctcctggat
ctagaacccaccaacctccacgggggcttgtgactgtttactaagtgagaaaaggagta
gggtgagttcgaggcatctgtgaggtccatatgccttctgacctgctcccccacaggacc
cctagcccactcaggtcctgccatgtccccagttgaagga >IGR1351a
ttgagagtgagccctgactgtctggtctagtctcctggatctagaacccaccaacctcca
cgggggcttgtgactgtttactaagtgagaaaaggagtagggtgagttcgaggcatctg
tgaggtccatatgccttctgacctgctcccccacaggacccctagcccactcaggtcctg
ccatgtccccagttgaaggaagccccactctgcagaagatgccttggcttttgtgggagg
ggcttcccttgtagttccctgagaactgccttccagctgggatggctgggcagaaggcgg
actgtagtcatcacagaggaatgctggccgtggggtcagccacttccttctctctcccagg
gcttggagctcaggccaggattatggtgggttggccctggatctgagacaagaaggctg
ggagtttgggtggcagagggagagtccagtaccctccctgatctctgcagcccacagcag
tacctggggtcaaggtggacagtgtcactggcaagcccatgtttcctaaatgcatgcctt
tgagaccacaagtctatggtaaggatctctttccttatggccctgagaccatggctcttg
gaaagacataaatcagactaaatggagctccctcagcccagaagagctggggctgggca
ggtatcagtggtggctattctggaagcagccagctagcca >IGR1352a
agtgtcactggcaagcccatgtttcctaaatgcatgcctttgagaccacaagtctatggt
aaggatctctttccttatggccctgagaccatggctcttggaaagacataaatcagacta
aatggagctccctcagcccagaagagctggggctgggcaggtatcagtggtggctattc
tggaagcagccagctagccagtggaaggagaggcagcaagacctccctagcatccctgta
tggaagcagccagctagccagtggaaggagaggcagcaagacctccctagcatccctgta
ggccagggaaagtccaaatactgcaagagtggagcttgtgccatgagcgcctggcaaccc
tggtgactcaacctggggaatcccaactccaggggcagccctggaaatgaggctcaggac
agtgaaggagtgccacggaggggcccaccaaccgtggcagcttttagtgaggccacagat
caaataggttgttgtcccttcttctcctgtggcccaggggttagaaacagtgatgctggt
cctctgcccggtccaaatagtattttttgatccagggaatccaactctaatcctagcccat
aaatttgacctggcagaggacctggtcctcagaatgtctgtgttgggctccatttgatgt
tacatcttagaaatggtagatgtagctcaagctaataaat >IGR1353a
cttttctcctgtggcccaggttagaaacagtgatgctggtcctctgcccggtccaaatag
tattttttgatccagggaatccaactctaatcctagcccataaatttgacctggcagagga
cctggtcctcagaatgtctgtgttgggctccatttgatgttacatcttagaaatggtaga TABLE 5-continued tgtagctcaagctaataaatacccacaggaatgtgtctttgtggtctggactcagcaaat
gctgagttattggtatatttatggaaggaaagcagggcagagacaggagaacaggtgtcc
ctgtgggtgctcggccctgttcactgttgtagcctcaggagccagcctcagctgagcaga
gagcaggtgcccatgaaccagtgtgacatggttggatggatggatggatggatgatgg
atggatggatggatggacgaacagacagatggatagataggaatatggatggtgga
ttcagatggcctcagcagcatgcacattttccccacgatggtctttgcaataagacaatt
ccacagaaactggtgggtgccccagaaggaggggaggaagaatgtggcttctccaagca
gcgctgtggttgtttctgccaggttctatctctcaaggggacctctgctcccttttccca
tagccctgttgacatgtgtggcccctcaaagtcctgcaga >IGR1354a
tgcacattttccccacgatggtctttgcaataagacaatttccacagaaactggtgggtg
ccccagaaggaggggaggaagaatgtggcttctccaagcagcgctgtggttgtttctgcc
aggttctatctctcaaggggacctctgctcccttttcccatagccctgttgacatgtgtg
gcccctcaaagtcctgcagagactgggagcctagtggcaagggccacccagacacagaac
aggggaaaggagctgttaacattagctggctgttccattcctctcctggaaagtaggtcc
acaaagaaatttaggtaggacctcagccaggtgtgaaagattccagttttttttctctgca
tgagtaagtccttgggaaagcatctgttgaccaattgactgattgactggcaagaggagc
aaaggggtcagcagagacccacctgcctggatggtgtgggagaaagcatgaccgccctcca
ccttgacaggtgacaaaccacagtgaatgtgtcaccacatcagatagccagcatgaattg
ctgcactgggagtgtttaaaggtctgggtgcataattgggagcaaaatggacaagggtat
gctgggagctctaagccaggaggcctctggtggctagtcacctccaggaagcaaaagcca
ttatttcttccttgagaatccccgtgaatattggagaggg >IGR1355a
cagtgaatgtgtcaccacatcagatagccagcatgaattgctgcactgggagtgtttaaa
ggtctgggtgcataattgggagcaaaatggacaagggtatgctgggagctctaagccagg
aggcctctggtggctagtcacctccaggaagcaaaagccattatttcttccttgagaatc
ccgtgaatattggagagggcttctcacagcccatgggctggggcatgagtgtgttatg
ctttgcttttagtggaggaggtgactccagaaggctaaagatttaggtgacagctgatggt
cctggaatgcttctcagccttgggcctacgctgggccctgtgaggggacttagaagtaag
caccgtggtctccactactaacctgcatgtgagctctccaaggacagaggatgctcagaa
ccaccccacaccccactctggcacccagcacattgctctcaggcagtaggcacttagt
aagtgtgctctgattgcagtgccagacgtatgtcatacctcgagtaagaggcaaagaggc
agagatgctgggagtatggagacggagcaggttatctcagtcattgttcacagatggcta
ctctgaggaggggacagttcagcaaagcctcaaaggatgagtcaaaggttaataggctaa
tagtaggggaggcattccagaatgtgaaaacagcccaagg >IGR1356a
gccagacgtatgtcatacctcgagtaagaggcaaagaggcagagatgctgggagtatgga
gacggagcaggttatctcagtcattgttcacagatggctactctgaggaggggacagttc
agcaaagcctcaaaggatgagtcaaaggttaataggctaatagtaggggaggcattccag
aatgtgaaaacagcccaaggaaaggcttggcagctcagaagtgcagaacggatctcgctt
ttggtgtggcctggagtagctgccccagaagctgaggctggaccaaccagtaggggccac
actctgaagagcctggatgctgtgctcaagagtggactctatcctggtagacagaggccg
ctcagggctggactgatgttgccttccttctggagccaaggcccagaccagggtctatc
atcaggtgtctgttgaattaaatgctagggcaggtcttgtgagggccactggtggcctga
cctatgctttagaaaactttctgtggctgctacagaggattacgcctgtggcacaccagg
gcaagactagggtgagatagtttcctaaaggcacaacatttaaggaggtactcgctctca
gggccaacccctatacttgggtgagtctgacggtgagtagctccttaaaggtttcaccct
aagcacctgccctgcctgcttgctccaccctatctggtcc >IGR1357a
ctgtggctgctacagaggattacgcctgtggcacaccagggcaagactagggtgagatag
tttcctaaaggcacaacatttaaggaggtactcgctctcaggggccaacccctatacttgg
gtgagtctgacggtgagtagctccttaaaggtttcaccctaagcacctgccctgcctgct
tgctccaccctatctggtcccttctgcacactggaggctggggaggtagactagaggcagc
tcaagtgatccaggcatattagggctgtggccacaggggatagagatggcctagttgag
agcagaatcagatgacaggatttgccaggacatgagactggctggagcaggaccccatccc
ccctccctgggtgcccattctgggagaagtgtaggagaccccccactctgcctaggagt
ctatatgtccacagccagggccaaaacaagatcttaggccttggcttctgtcctaggtta
tgagtctagggaaccaaggacactaagctaaagagagtagggcagcaggtgaaaaagcca
caggctgccccaggaaggcccaggccactggagaccacagctagaacctacaaccatgtc
ccgagactgctcggccttgccctttggatgcttgggcacagcaggaaggaagtgataagg
gtgcctccactgctggatgggcgtgtctgtcagtccatc >IGR1358a
cactaagctaaagagagtagggcagcaggtgaaaaagccacaggctgccccaggaaggcc
caggccactggagaccacagctagaacctacaaccatgtcccgagactgctcggccttgc
cctttggatgcttgggcacagcaggaaggaagtgataagggtgcctccactgctggatgg
ggcgtgtctgtcagtccatcttcccccgctgtctgcccagcaagaccagggcaccc
cagtgctcccaggggattagcagcttggttccccagcccacacccctagaagctctga
ccctatggcaacagcacccctgctggctaatatggaaaaccaacccctttccctcctct
agcaggcggaagtttagggtcttggagaaagagaagggtgcaggcacaatgctgcggga
aagggtggggcaggaattcaggatggactttggctatggcagataagcaggtgccacct
ggtaaacagagcaccctatttcctgatcagtagccttgaacagatgccagagaggccagg
acacaagcaaaggcagaaatggggttctaaggtaactgctgagcgaggctggctctcg
tgggagtccctgccttctcctacagcatcatggcccaggaaggcctgcatcctctgttga
gcactgttctcctcaggtgggctcaggaactccctcagat

TABLE 5-continued

>IGR1359a
cctgatcagtagcctttgaacagatgccagagaggccaggacacaagcaaaggcagaaat
gggggtttctaaggtaactgctgagcgaggctggctctcgtgggagtccctgccttctcc
tacagcatcatgggcccaggaaggcctgcatcctctgttgagcactgttctcctcaggtgg
gctcaggaactccctcagattcccctgagcaagccacctggccccacagaggatttggc
ctaggactgaaggctgagagctaggcctgagacagggtagtgccccaggcacccaaaaa
gaggatttgtccctaaaattcctcccgcaactatccaaggctaggaatagaggcagggac
acatcagcagaacaaaatctcagagcgtccctgagcagctgcctggctcttcagatgcaa
acctggttagacacacacttctcctgagctctaggcccatggctcaggcacaaggaccac
ctcggagtgctggatgaggtgcccagtggacagaggagtgagaggacccagtgtatgcca
ctttgacccttcagctgtgagccaggaagtccaggcagacacagccacaagcagggccat
gccctgggcagccacttcccagaaaagtttctgccgcaaaacagagagagtggccttccc
tgccctgcatgaccctggcacctggagtcctcacctcaga >IGR1360a
gcccagtggacagaggagtgagaggacccagtgtatgccactttgacccttcagctgtga
gccaggaagtccaggcagacacagccacaagcagggccatgccctgggcagccacttccc
agaaaagtttctgccgcaaaacagagagagtggccttccctgccctgcatgaccctggca
cctggagtcctcacctcagataagaagccagtagttctaggagtttacttacatcatggc
tcttgattacagtgaagaccgggccttgncctaccccagggaaacttctctcccgggcc
aatggtgtggatggctgctgttctcttatgactcagtgtgggcctggtgctcaggagagc
tgctccttcccatgccctggatgtgagctcagcagccatcttgattcaccaggacaatgt
gagctccacacaccaccctcagaccctcacctaccgggctctcagggagagatgaggcct
cccggagagtccacaaagagaaaaaagcggcttggctgccaaaactgccacgcaccccca
gatgccatgctcagctagcagccctggtgccacacagcctgagagcaggtgggagccata
gatgcaacaagctgtcatcaggcatgggagggctgggctgccatgctgaggctggtgggg
tgggaaaatcaacttgcagccaccaggaagtacaggagca >IGR1361a
aaaaaagcggcttggctgccaaaactgccacgcaccccagatgccatgctcagctagca
gccctggtgccacacagcctgagagcaggtgggagccatagatgcaacaagctgtcatca
ggcatgggagggctgggctgccatgctgaggctggtggggtgggaaaatcaacttgcagc
caccaggaagtacaggagcagagtaaacaacagttgaggtcaaaagggtccaatttcctt
ggacaagcaggcctcaagaaggcctctgagctgcactgccaactgtattgtattcttgtg
tgtgttctgtgtgaacctaacaccccggcggccaagggaagccccttggccctcccttg
ggtggcagccaacactaggaccagagaagtggcagttgtgtcataaagttcccaagacac
ttctggaggaatcaatcttcttttttagtcttctctgctcatttttcttgtcattttcc
tgtatgtatatcttttccctctctcttctagcccagaaatgcttattgaccactggtggc
ctattgggagtggattacttgacacattcacatttactctgtgcccagatgctaggcaca
gaagtaggtgctatgggcacaggcattcgacaagaatttattgagcccatactatgtgcc
agacatggctctagaccctaaggatatagaaatgaataag >IGR1362a
ctctcttctagcccagaaatgcttattgaccactggtggcctattgggagtggattactt
gacacattcacatttactctgtgcccagatgctaggcacagaagtaggtgctatgggcac
aggcattcgacaagaatttattgagcccatactatgtgccagacatggctctagacccta
aggatatagaaatgaataaggcaacacccctgctcttatgaaactcataaccggtggag
gcagacaacacacaaataaacaaggaaagtgtcacatcgtgataattattctgagaaata
aaatagcatgatatcatacagagtacagaggtggtcacattagatttggcactctaggac
tgtctatctgaggaggtgacattttagttctctaagtgacagaagggtgacaatgtgca
gaacaagggaagtgcattccaggcagagggaatagctagtgccaaggccttgggaaaag
aacaagctcagtctgtttgcaggaaaagattggtgtggctgcagcatggtgggcaaggag
gtgaatgatagacgatgaatgatagaacatgcagctcataaggtaggaaggggtcagata
aggtgggcatttgggccctctgatcagggggcttgggccttatgcacagggtgaaatgggc
cagtgtgcattttacttattttaaacttttaagttttct >IGR1363a
aggaaaagattggtgtggctgcagcatggtgggcaaggaggtgaatgatagacgatgaat
gatagaacatgcagctcataaggtaggaaggggtcagataaggtgggcatttgggccctc
tgatcagggggcttgggccttatgcacagggtgaaatgggccagtgtgcattttacttat
tttaaacttttaagttttctgttttcattttttagatggaaaaatgttgtccaggctg
gtctcgaactcttgagctcaagcatttatcctgcctcagcctcctgagtagttgggatta
caggtgctcatcactgtgcctggctcagtgtgcattttagaaagctcactggctgctgtt
tgcagactgggctgcagtgggcaagtgtggaaataaggagaccactggggagactggag
taggagggatgaactagagtggtggtggtggcaatgatgagaatggggaatgaacccagg
cagagtatagagggaggacacacagagatgaataaaatgtggtggctccgaatgggaga
aaatatttgcaaaacatatatctagtaaagggtatgtatctagcatatgtaaagaatgct
tacaactcaataaggcaatgcattttgtttgtttgtttgtttgttttttgagaca
gagtctcactctgtagcccaaactggagtgcagtggcacg >IGR1364a
acacagagatgaataaaatgtggtggctccgaatgggagaaaatatttgcaaaacatata
tctagtaaagggtatgtatctagcatatgtaaagaatgcttacaactcaataaggcaatg
cattttgtttgtttgtttgtttgttttttgagacagagtctcactctgtagccca
aactggagtgcagtggcacgatctcagctcactgcaaccttcgcctcaggggctcaagcg
attcttgcgcctcagcctcctgagtagctgagactacatgcgtgtcaccacgctcagcta
atttttttgtcttttaagcagagatgggttttcaccatgttgcccaagatggtctcaaact
cctgaactcaggtgatctaccacctcagcctcccaaagtgctgggattacaggcatgag TABLE 5-continued ccactgcacccatcttgacaaccaaattttttaatggacagaagatttgaacgaatttt
cgccaaaaaaggatacgcaaatagtaaatacacatatgtaaagatgctcaacatcattag
tcattagggacatgcaagttaaaaccacgatgaaatgccactacacatctacctggatgg
ctaaaatgaaaagactaactgtgccaagtgttggcaatgacgtggaacaactgggatgc
tcctaaactgctggtgggaatgtaaaatattcattttttc >IGR1365a
atagtaaatacacatatgtaaagatgctcaacatcattagtcattagggacatgcaagtt
aaaaccacgatgaaatgccactacacatctacctggatggctaaaatgaaaagactaac
tgtgccaagtgttggcaatgacgtggaacaactgggatgctcctaaactgctggtgggaa
tgtaaaatattcattttttcttgacttttaatagagatagggtctcagtatgttcccca
ggctggtcttgaactcctgagctcaagtaatcctcccactttggcctccaaagatgctgg
gataacaggcgtgagccaccatgcccagctgggaaggtaaaataatacaactacagtcac
gtgctgcataatgattttggtcaaggacagactgcatatacgacaatgatctcatgaga
ttacaatactgtatctttactgtgccttttctgtgtttagatatgcttagatacacaaat
atttacccttgtgtggcagtcgcctacagtgctcagcagagttacttgctgtacaggctt
gtacccctaggagcaataggctataccacatagcctaggtgtttggtaggtttataccatct
aggtttgtgtaagtacactctatgatattcacacaaggacaaaattacctaatgaagcac
ttctcagactgtatccttgttactaagcaatacatgatta >IGR1366a
cgcctacatggctcagcagagttacttgctgtacaggcttgtaccctaggagcaataggc
tataccacatagcctaggtgtttggtaggttataccatctaggtttgtgtaagtacactc
tatgatattcacacaaggacaaaattacctaatgaagcacttctcagactgtatccttgt
tactaagcaatacatgattacattggaaagcaatttggcagttttttaaatagctaaata
tatgcctatcatacagcctagccattcaattccaggtatttatccacaataaaggaaagt
gtgtgctcacacaaagatttggatatgaatgcttacagcagcttaatttgtaatagccaa
aacctggaaacaacaaaaatgaccatccacaagacagtggatataatagcttatggtatct
acgcagtggattaccaccaggttccaggtttaggtaagataaagtaaacatactccaccc
tgtctcttccactaagtgaagcaatagaacctgtacagaatgtatgaaggactctgaaga
gtaaatagcagcagatgaattaggaaagaaaaatcagaatttggagtaccacggaattgg
aggagtttcccattttttccctctagtactccctgggctagactcgaaacagcctgaaacc
tggaagtgagcagcaggcacagacagtgggaatcccagag >IGR1367a
gcaatagaacctgtacagaatgtatgaaggactctgaagagtaaatagcagcagatgaat
taggaaagaaaaatcagaatttggagtaccacggaattggaggagtttcccattttttccc
tctagtactccctgggctagactcgaaacagcctgaaacctggaagtgagcagcaggcac
agacagtgggaatcccagagccctctagttctgcttgaggagtggggagggaactccta
atgctcagaaagagtgagaaaataaccaccccacgccacctttttttcttttctccatt
ctctcatgcctcagacctctggcattcttgttgcaatgcatgaaggactaaaggcacc
taaaattctaagggagagaaaactgtctgttggacaagcccaagagggtctccctcctt
cccccttctctctctctctctctctctctctctcaatatctctctcctttttgc
cagttgaccctagctgagggcacagtcgcaggaagtacacagcagagcaaggtagctaaa
actccagatttctggccagaggaccaaaaggaggagacccagggaatcagaaagtaccag
ggagatcatggaaagggaggaatgctggaaactgaacccacaaagttgtttatgaattcc
tgggctcaactccaaactgagcttgcatggatctagcata >IGR1368a
cacagtcgcaggaagtacacagcagagcaaggtagctaaaactccagatttctggccaga
ggaccaaaaggaggagacccagggaatcagaaagtaccagggagatcatggaaagggagg
aatgctggaaactgaacccacaaagttgtttatgaattcctgggctcaactccaaactga
gcttgcatggatctagcataccaaagacttgagaactgaacctaaggataaacaccaccc
ttttctcaagctgaccactggagggtgcacacacaggacagatctaaacagcactataaa
ggctttgaaaatggaacaaacattgaaactacaatccacagaaggctggtcggaacttgt
ggcccaaatgcagctgcattgattgcctgctaaaatataaacattaacactctccacaat
gttcaaataatacccagagtctcataaaatttaaaatgtccaggatacaaaaccaaagta
tgatcctcctggcctatgataggaaaaatctcattttgcatgggaaaagacaatcaaaag
agaacaatgatgagatgttggaattaagtaacaaagactttaaagtactactatgaaaat
gctccaagtaaaccctcttggaatgaatggaagatggacagtctcagcaaagaaatagga
gatataaagaataggggaagtaaagttttggaacttaaaa >IGR1369a
aggaaaaatctcattttgcatgggaaaagacaatcaaaagagaacaatgatgagatgttg
gaattaagtaacaaagactttaaagtactactatgaaaatgctccaagtaaaccctcttg
gaatgaatggaagatggacagtctcagcaaagaaataggagatataaagaataggggaagt
aaagttttggaacttaaaaatataagggccaggcatagtagttcatgctataatcccaa
cactttgagaggccaaggcaggaggataacttgagcccaagagttcgaagctagcctggg
ccacaaagtgagaccccgtctctaaaaaaaataataagttaggtgtgttggcatgaacct
gtggtcctagctacttggaaggctgagatggaggatagctcaaacctgggagttcgagg
ctgcagtgagtcgtgatcacaccactgcactacagcctgagtgacaaagcaagaccccgt
ctcaataaataaataaataaataaataaataaataaataagaaccaaaatttcagtg
ctcactaggtaactcaagagcagaatataaatgagaggaaagaggaagccagtaactgga
agacagaccaacagaaattatccaaacagaaaacagtgagaaaaagattttttaaaaagt
gaatagaacctcagagactagtgagacaataccaaaggtc >IGR1370a
ataaataaataaataaatataagaaccaaaatttcagtgctcactaggtaactcaagag
cagaatataaatgagaggaaagaggaagccagtaactggaagacagaccaacagaaatta TABLE 5-continued tccaaacagaaaaacagtgagaaaaagatttttaaaaagtgaatagaacctcagagacta
gtgagacaataccaaaggtctaatatttatgtcattagagttccagaaggaaagaagaaa
gagtgcagtgaagataaaaatgtttgaggaaatattgactaaaaacatcttcaatttgga
aaaggacataaaactgaagaatatatgtacatatatatatatatatatatacacacatac
atacatataagcatacatgtaccattgctagagaaaaatgacacatcacacataggagaa
caattcaaatgacttcagcttcctcatgaggagagaggaaatctcatcgtagagaccagt
aggaagtggaatcacatctttaaaatgaagaaaaagaaccatcaacccaccattctcttc
acaatttcaagaatactcaatgaaaatatgcctcaggagtgagagtgaaataaagacgtt
ttcagatgaaggaaaactaagagagttctttgacaacagacccgtcctaaaataattgct
acaagaagttttcagacagatgagaaatgataccagaag >IGR1371a
taaaatgaagaaaaagaaccatcaacccaccattctcttcacaatttcaagaatactcaa
tgaaaatatgcctcaggagtgagagtgaaataaagacgttttcagatgaaggaaaactaa
gagagttctttgacaacagacccgtcctaaaataattgctacaagaagttttcagacag
atgagaaatgataccagaagttaacttggaatatcaggaatgaaaaaaagaccaacagaa
atggtaaagatctgaggtaatgcaacattctgtgctgctcttgagttctttaaaatacgt
tttatggttaaaacaaaaattataacattttttgatggtgttttcaatgttatatgtaga
tagcacataagacaactacaacataaagagggtagaataaaagaaactaaagtttttacat
tacacttaaaatggtaaaatattgattctaagtagaccatgaactgtgaaaaggtaaagacgtatat
tgtaatccctggagcaaccactaaaaacaaaaacaaaaacaaacagaactatacaagcag
ataaagttaaaaacacaatataatgtccttaaaatggtagacacaaatccaaccatatcag
taattccattaaatgtaaatgatctaagaatggtatcagcaaaaatggaatagagaactc
caaaactccttttttccataaaaaacagtgaaaaaaactgg >IGR1372a
ctaaaaacaaaaacaaaaacaaacagaactatacaagcagataaagttaaaaacacaata
aatgtccttaaaatggtagacacaaatccaaccatatcagtaattccattaaatgtaaat
gatctaagaatggtatcagcaaaaatggaatagagaactccaaaactccttttttccataa
aaaacagtgaaaaaaactggcaaaatcaactttattagaactctggagactaataaaaag
tttaataaataaaataaattctttttttttaataaaataaaattcttttttttttttttgag
ggagagtctcattctgttgctctggctggagtgcagtggtgtgatcttggctcactgcaa
ccccacctcctgggttcaagcgattctcctgcctcagcctcctgagtagctgggattac
aggtgccctccaccatgcccagctaatttttgtattttcagtggaggcagggtttcacca
tgttggccaggctggtcttgaactcttgacttcaaatgatccacccacctcagcctccca
aagtgttgggtttacaggcatgagccacaatgcccagccaataaattttaatcaagaaga
aaaacggctaaatctcagtgggaaaacactgtggtgttttaacatacctgggctccattc
tcctcttccccagcttggtggcagccttgaagacaacagc >IGR1373a
aactcttgacttcaaatgatccacccacctcagcctcccaaagtgttgggtttacaggca
tgagccacaatgcccagccaataaattttaatcaagaagaaaaacggctaaatctcagtg
ggaaaacactgtggtgttttaacatacctgggctccattctcctcttccccagcttggtg
gcagccttgaagacaacagcctgcattcttgatataggttcttagtgttcgagggagcag
aatggaacttactctcaaaggattgtggttgcctgttttgacctgtctgttggttccctg
aaggatgagcacaaaagatttactttaatttcacctaacttagaactctcccagggctga
agcagctacctgggcatttggaaaaacaaacaaaccacacacacatgcacagagttaaaa
aacaaatgcattcactaatggtaacagttagggaaataatagacaaaccaaaagcttaag
aaaaaaggctggagaaggaaacactttaagaaataagggctttaaaaagctttctggata
tctaagaaggtcacacatatgctcagaaaatatcctagaagactctacactctcacctct
gactgacctccagactctgcaagcagaaaaggaaggttaaggcagagttgtaaacagcct
ggctaagtgttaaaagccacacctcaaaacacatacagag >IGR1374a
acactttaagaaataagggctttaaaaagctttctggatatctaagaaggtcacacatat
gctcagaaaatatcctagaagactctacactctcacctctgactgacctccagactctgc
aagcagaaaaggaaggttaaggcagagttgtaaacagcctggctaagtgttaaaagccac
acctcaaaacacatacagagctcatctgaagatatttgggaattttttttttatgttgttc
taggtataaaggaaatttcagtcatcactagccaaccactagtggaaaagtttaatggaa
aagtcttttcagtgccacacgtgacaaagaatacagactttaaaaaattagttcagaaa
ggtcactaagtaaacaacaacaacaacaacaaacaaaaacaactagcaaacaatgac
aacaaacctgaaagggagcagaatgtgatttccagagttgtcacattataacagtaaaa
atgtccagttttcaacaaaaaaattacatgccatgaaaagacagaaaaaagtatggttc
atacgcagcaaaataattaatagaaactgtccttgaggaagctcaggaattgaacttaa
tagattaagatttttaaatcaagtattttttaaatgtactgaaagagctaaaagaaaccata
tgcaaagaactaaaggaaagcatgaaaacagtgtctcgcc >IGR1375a
aaaattacatgccatgaaaagacagaaaaaagtatggttcatacgcagcaaaataatta
atagaaactgtccttgaggaagctcaggaattgaacttaatagattaagatttttaaatca
agtattttttaaatgtactgaaagagctaaaagaaaccatatgcaaagaactaaaggaaag
catgaaaacagtgtctcgcctaatagcagatttcagtaaaagaataaaattataaaaaa
ggacttagaaattttgagttaagaagtaaaataagtgaaatgaacaatgcactagaaggg
gtcaacagctatgtgagtaggcaaagaatgaatcagtgaatttgaagacaggtcaattga
gattacccagtctgagggacagaaaaagaatgaagaaaaacaaatagagcgtaagtggc
ctgtggaataccactgatggtaccaacatatgcataccagaagacccaggggagaggaa
agaaagaaaggggatgaaagaatatttgaagaaataatggctcaaaacttctcaaatttg TABLE 5-continued gtaaaagtaaaggatatgaatttacacatgcaagaagctcaacaaacccaagtaggata
aactcagatattcatattgtgatacattataatccaatggtcaagataaatacaaagaga
gaatcctgaaagcagtcagagagaagtgatgagtcatata >IGR1376a
aatatttgaagaaataatggctcaaaacttctcaaatttggtaaaagtaaaggatatgaa
tttacacatgcaagaagctcaacaaacccaagtaggataaactcagatattcatattgt
gatacattataatccaatggtcaagataaatacaaagagagaatcctgaaagcagtcaga
gagaagtgatgagtcatatacaaggatacttaatgtgattaatggctaatttcccatcag
aaaccacagaggccaaaaggcaatatgatgacatattcaaagagctgaaagaaaaactgt
caaccaagaattccatatgtggcaaaactattcttcaaacatgaaggagaagttaagaca
ttcccagataaacaaaaactaacagagttctttgctagtatgcctgttgtacaaaagttg
ctaaagggagtccttcaggctgaaatgaaagaacacttgtgatgattaattttatgtgtc
aacttgactgagccacaggtgcctggatgtttggtcaaacattattctggatgtttccg
tgaggatgtttacaggtgaaaataacatttaaattggtacactgagtaaaggagattacc
ctccctaatatgggtgggcctcattcaatcagttaaaggcctaaatagaacaaaatgact
gacccttccccaagtaaaagagagtttctcctgcctgcct >IGR1377a
tgcctggatgtttggtcaaacattattctggatgtttccgtgaggatgtttacaggtgaa
aatacatttaaattggtacactgagtaaaggagattaccctccctaatatgggtgggcc
tcattcaatcagttaaaggcctaaatagaacaaaatgactgacccttccccaagtaaaag
agagtttctcctgcctgcctatctttgaactgggacattggcttttttcttgccttcagac
tcaaactgaaacattggttctttctttgtctggagcctgctggccttcagactagaacta
agtcattaactctcctgggtctccagcttgccaagtcaccgtggagattttggtacttgt
cagtctctgtaatcatgagaattaattctttataatctcctctctctctctctacacaca
tacacacaaacatgtgtatatgtatatacatatataatatatatatatatacagcttg
ctggttctgtttctctggagaaccctgactaatacaactaatacaacattatgcagtaac
ttaaatccacatgaaaaataaagaacaccagttatgataactatgtaggtaaatataaac
attaatattaatgatatattttttgttttaaactctttattttctatatgatttaaaata
caatcataaaacaatgatcctaaaactatgttgatgggca >IGR1378a
aaccctgactaatacaactaatacaacattatgcagtaacttaaatccacatgaaaaata
aagaacaccagttatgataactatgtaggtaaatataaacattaatattaatgatatatt
ttttgttttaaactctttattttctatatgatttaaaatacaatcataaaacaatgatcc
taaaactatgttgatgggcataggttgcataaagatggtttggtgttttttgttttttgttt
tttgtttcttgggttttttgttttttgttttttttgtagacagagtctcactctgtcaccca
ggctggagtgtagtggcaccatcttgactcactgcaacctccacctcccaggttcaagca
attcttgtgcctcagcctcctgagtagctgggattacaggcacataccaccacgcccagc
taattttttgtattttttagtagacatgggtttcatcatgttggccaggctggtcttgaa
ctcctggcctcaagtgatctgcctgcctcagcctcctaaagtgctgggattaaaggcatg
agctaccaccccggccacattacataaagatgtaatctgtgacattaacaacaaaagtta
gagatgaaattatacagcagtaacttttttgtataccattgaaactaagttgttattaat
ttaaattagagtgttgtaaattaagatgttaattgtaatc >IGR1379a
gcctgcctcagcctcctaaagtgctgggattaaaggcatgagctaccaccccggccacat
tacataaagatgtaatctgtgacattaacaacaaaagttagagatgaaattatacagcag
taacttttttgtataccattgaaactaagttgttattaatttaaattagagtgttgtaaa
ttaagatgttaattgtaatccccaggacaaatgctaagaatataatatgtagtaaaataa
atgagaaaggaatcaaaagagtatactacaaaaatctatcttacacaaaagaagacaata
atggaggaactgaggaacataaaggataaaagacataatagaggacaaatagcaaaatga
cagaattaagttctctcttatcagtaattatattaaatgtaaatgaattaagctctcaa
tgaaaaggcagagattggcagaatggattttaaaaagaaccatgatccaactatatgctg
tctataagagacttatttagattcaaagacacaaataatttccaagtgtaaagatggaa
agcataccatgcaaacagtaaccaaaaatgagctgaagtggctatgctaatatcagacaa
aatggacattgacacaaaaatgtttcaaaaaacaaagaagtacattaatatgataaaatg
ctcaatgtattaagaagatattgcaattataaacaaatag >IGR1380a
gattcaaagacacaaataatttccaagtgtaaagatggaaagcataccatgcaaacagta
accaaaaatgagctgaagtggctatgctaatatcagacaaaatggacattgacacaaaaa
tgtttcaaaaaacaaagaagtacattaatatgataaaatgctcaatgtattaagaagata
ttgcaattataaacaaataggcacttaacaacagagaccaagaacctatgacaaaagatt
gacagaattgaatgaaaagttaaaaaatagtcggaggcaaggtgcagtggctcatgccta
taatcccagcacaatgggaggctgaggcaggcagatcacttgaagtcaggagttcgagac
ctgctgggccaacatggcaaaaccccgtctctactaaaaatacaaaaattagccaggcat
ggtgaagcacacctgtaattccagctactcaggaagctgaggcacgagaatcacttgaac
ccaggaggcagaggttgcagtgagccaaggtcatgtcattgcactccagcctacatgatg
gaatgagattctatctcaaaaaaaaaaaaaaagttggagacttaatactcatgttcaatc
gtagctagaacaactagacaaaaggtaaacaaagaaatagaagacttgaacaacaataaa
agccaccaaacctaacagacatctacagaacatttcattc >IGR1381a
tgagccaaggtcatgtcattgcactccagcctacatgatggaatgagattctatctcaaa
aaaaaaaaaaagttggagacttaatactcatgttcaatcgtagctagaacaactagaca
aaaggtaaacaaagaaatagaagacttgaacaacaataaaagccaccaaacctaacagac
atctacagaacatttcattcaatgacagcagaatacatattattcttctctgcacatgga TABLE 5-continued aatattctatagaagagacattgtgttaggccacaaaacaagtctcaataaattagacaa
gattgaaatcaaacagggccaggtgtggtgcctcacacctggaatcccagcactttggga
ggccgagacaggcagatcacccgaggtcaggagttcgagaccagcctgaccaacatggtg
aaacccccacctctactaaaaatacaaaattagctgggcgtagtggtgcatgcctgtaatc
ccagctactcgaggggctgaggcaggagaattgcttgaactcaggaggtggaggttgcag
tgagccgagatcacaccattgcacttcagcctgggcaac >IGR3209a
ttgtggcaaccccaggaaatgaatagatcaggagcccagatggagtctgagggccttatg
ttaagggctgagtggtgaaagtgaggctacaaaggcagaggtcagaaatggtatcttctg
ggtggaggcaggtagaggaaaaggaatataaaaacaaatgaatggccacttcctgcaagg
caggaagaccaaggagacatgatcctcagaagtcctgcccctttctcaaggctgcagattt
tttaggaggatatctgaccaatgctgtggtcctgagctgccaggactccaagaccctgcg
gaggtcttactcatgcctttggagactaaatcttacagtgtggagcaaggtattgaggag
atatccgtccattcaaggagttagcaaatatnngcccagttcggtggtgggaaaatggca
atggacaaatgcatgcatggtttatgtactcccagnccgcccaggccagtcggggagag ac
gttacccaagcgatcattcaattctatcaacggtggcaagtgttacgaagcacacgggga
catgagaagctgttatgggaggttttgtgtgtgtggttttttttttttttttttttgagac
agtcttgctcttgtcacccaggctggagtgcaatggcacgatcttggcttacggcaacct
ctgcctcctgggttcaagtgattctcccacctcagcctcc >IGR3210a
attctatcaacggtggcaagtgttacgaagcacacggggacatgagaagctgttatggga
ggttttgtgtgtgtggttttttttttttttttttgagacagtcttgctcttgtcaccca
ggctggagtgcaatggcacgatcttggcttacggcaacctctgcctcctgggttcaagtg
attctcccacctcagcctcccagtagctgggattacagacaccgccatcatgcgtggct
cactgcaagctctgcctcccgggttcatgcgattctcctgcctcagcctcctgaatagct
gggactacaggcatgcgccatcacacccggctaattttttgtattttttagtagagacggg
gtttcatcatgttagccaggatggtcttgatctcctgaactcgtgatccacccgcctcgg
cctcccaaaatgctgggattacaggcgtgagccaccgtgcctggccatgcccagctaatt
tttgtattgttgtagagacggggtttcaccatgtcggccatgctggtctcgaactcctga
cctcaggtgatccgtccgcctcagccttccaaagtgctgggattacaggcatgagccacc
gtgcctggtctgttatgggaggttttgacctactagggaagtaaggaaaatctctctgc
ctctgagggaatctgaaggattctgaaggttttaatcagg >IGR3211a
gggtttcaccatgtcggccatgctggtctcgaactcctgacctcaggtgatccgtccgcc
tcagccttccaaagtgctgggattacaggcatgagccaccgtgcctggtctgttatggga
ggttttgacctactagggaagtaaggaaaatctctctgcctctgagggaatctgaagga
ttctgaaggttttaatcagggggggaaaattttttctagacagaaggaacagcatgtata
aaggtctggggtggggaggggaatgnccagttagagagactggaggaagttcgatgtgg
ttacagaagtgagcagaggccaaaccatgtggaaccttataaaccacttttttgatgtttc
tcangatcaggncaatttcccagntgcaagtaatggnctcagatctgcattttgagatca
tcatggttgtantgaaggagagatgagagggaacnnnaatggaggagcagccagtcagga
aagtgttgccatcactcatgtgaaaaagatggagagaagtgggtggattagagggagatt
taggggtaaaattgaacagacttgggatataggtaaataggctgggatgagggagag
ggagctgccaagtatgactcccaggcttctggttaggtaactgatgggaagtatctcctt
cagtacagcagtgaagacaggatgtgtggaggggggaagat >IGR3212a
tgaaaaagatggagagaagtgggtggattagagggagatttaggggtaaaattgaacaga
cttgggatataggtaaataggctgggatgagggagagggagctgccaagtatgactc
ccaggcttctggttaggtaactgatgggaagtatctccttcagtacagcagtgaagacag
gatgtgtggaggggggaagatgtaggggagaacaataactctgtgttggacatgttgcca
ttgaggtgcctgtgacactcaagtggggatgtacactgaacagtgagttacatgaatct
gggggttcagcagtaaggataagggtaaagagagaaatttgtgtcacctgcgtgtaaagag
aagcgtgaagtggaaagcctagacctgagttttgaggaaccccaaccctttactaatagg
gagaggatgctgaagaagcttgagcagaggtggccagaaaggatgaggggaaaccaaggg
aaaatcagtgttccagaggggctgtggtcatcgctgggtgtcagacactgctcagggccct
ggcagatgaggtctgaagaacagccgttgaaattggagattggaggctacagtttattga
gacctggtttggtgctgttaggagctagaaggctgactgcagggcctgaagagtgggag
agacagctcctttagggcctgaagagtgggagagatgtga >IGR3213a
ctgtggtcatcgctgggtgtcagacactgctcagggccctggcagatgaggtctgaagaa
cagccgttgaaattggagattggaggctacagtttattgagacctggtttggtgctgtta
gggagctagaaggctgactgcagggcctgaagagtgggagagacagctcctttagggcct
gaagagtgggagagatgtgaggatggggagacagctcttttcaagaaattccgctgcggtt
gagaacagagacactcagtggggtcgaatgagggttttgttcccatagtagaggcttgaa
cacatttacaggccaatgggaaagatccagttgagagcgggtagttgagccttcaggaga
gaaaagggatgttccatggggcaaactcctgagaaggggggaggagatggaaggaagcttc
tgtggatgtagcagatgcaggagggttttgtgtagttttagccgggctcgagccggtggct
gacgcaggcaggaacaatggctcacccatgttttatgtgtatttccgtgtgcgtgctcct
gctttccccaggtctgggccgcctgcctggcccgtgtgccgtagggaatatccacactgg
gcctgggcggaggctgggcatctcccgctctgggcttgctccctgatgagattctcagac
cgtgcttcccctcattcatgagangaaggttcacagagca TABLE 5-continued >IGR3214a
ctcacccatgttttatgtgtatttccgtgtgcgtgctcctgctttccccaggtctgggcc
gcctgcctggcccgtgtgccgtagggaatatccacactggcctgggcggaggctgggca
tctcccgctctgggcttgctccctgatgagattctcagaccgtgcttcccctcattcatg
agangaaggttcacagagcaggcgtgggaacctgcctggccgccagggcctcctcccgct
caggctgaggtttgctgcatctctgtccttattccctttccagactggattggctgaacca
ggtgtccactctttttggcccatggcataaagaagggtttgggcaacccagtgtgcccca
ggttgttaccgcccccccgcctccgcccccacccagcctttgatgggccccttctcatc
aatccatcacccctgcacatgccaccaggactgcctggaccagagcccgggactctctga
aacccactgagagctcggccctgggaatgggcctcccaatctcggtctccagggggtggg
ccccaggtccctagtcttcctcaggtcttctccactgttctgcctcctctcctgatacc
cagttcctagccggggtgaccccagcctcccgtaacagcctccttgtggtggtgctggga
agaaggggcccgtgtacccggcagggcccccaggcaatg >IGR3215a
ctgggaatgggcctcccaatctcggtctccagggggtgggccccaggtccctagtcttcc
tcaggtcttctccactgttctgcctcctctcctgatacccagttcctagccggggtgac
cccagcctcccgtaacagcctccttgtggtggtgctgggaagaaggggcccgtgtacccg
gcagggcccccaggcaatgggcatgagcgcaggcagggaaatccgtcagcctccaggga
cgctctccctacagccccggcgaggggatcgggtcgtggcgacctctccagacgcccagg
ggctgggcaggagggcgggccaagggcccgcaggtgggggcgccaaagccaggcgggcgcg
gagtacgtgcggtgggctgcgggcggcatgaagggcgcgggcggccagctccggctccgg
ctccggctccggctcccgcgaggccgggtagcctgggcgttcccaggggtcgcagaggat
ggcgaacccccggcgagccaccggagctggggaccaggacgcaggcaggcgtgtggacg
tgaggtggggacgtggcggcggctcaagtgggcggagccccggcagcggccggaggcgga
gtcgccaagggaggaggcgccgagctgaccgggcgacgccgcgggaggttctggaaacgc
cgggagctgcgagtgtccaggtgagcgccccgcccgctca >IGR3216a
ccggagctggggaccaggacgcaggcaggcgtgtggagcgtgaggtggggacgtggcggc
ggctcaagtgggcggagccccggcagcggccggaggcggagtcgccaagggaggaggcgc
cgagctgaccgggcgacgccgcggaggttctggaaacgccgggagctgcgagtgtccag
gtgagcgccccgcccgctcagccgccagatcaacttagcgctggggcgcgggctgggt
cgccaggcggtgcgttctgcccgcgcggggctgagagttaggggccggggccggatccgg
ggccgggggtcgcgccgctagccgccagcagcgcagtccgggccgccacccctgcaccctc
cgccctgtttctgcacccgtctgggttcttgtgccgccgcccaagccttcccgagctc
agggtggtgaggtcagcggcgcccttcgtgcagttccctcggctgtcgggcggggctggg
aacttggccgctcttccctgtcaggctcccgggaagtggcggcctgaccccgggctgccg
gctgttgggagcgggggcgcggcgtccgcctggccctgaggggcctcttcatattggcta
agcccgttctgcaccctccaagggctgggagtcctaggtcttgtccgggcagggtccag
cttggagcccattagatgggccattggatcagaaagtctt >IGR3217a
tcaggctcccgggaagtggcggcctgaccccgggctgccggctgttgggagcggggcgc
ggcgtccgcctggccctgaggggcctcttcatattggctaagcccgttctgcaccctccc
aagggctgggagtcctaggtcttgtccgggcagggtccagcttggagcccattagatggg
ccattggatcagaaagtctttttctcccccagacatccttgtggaaccagcgttgtttttc
cttggcagctgcggagaccgtgataattcgttaactaattcaacaaacgggaccccttct
gtgtgccagaaaccgcaagcagttgctaacccagtgggacaggcggattggaagagcggg
aagtcctggcccagagcagtgtggtgagcgctgtgctggaagggaatgcgggcagtggg
tacttggtagagcactgactgcctccggccagaggacttcccggaggaggtgacccatga
gctggagtggtcagaggaaggctggcaaaagggcatcgtggacagaggaacagcctatgt
gagtggnagcagagaccttggccaatgccattccttatgccttgtagtggaagcaaggt
gatgggaaggaacactgtaggggatagctgtccacggacgctgtctacaagaccctgga
gtgagataacgtgcctggtactgtgccctgcatgtgtaag >IGR3218a
gctggcaaaagggcatcgtggacagaggaacagcctatgtgagtggnagcagagaccttg
gccaatgccattccttatgccttgtagtggaagcaaggtgatgggaaggaacactgta
ggggatagctgtccacggacgctgtctacaagaccctggagtgagataacgtgcctggta
ctgtgccctgcatgtgtaagatgcccagttgaccttcgcagcaggagcctggatcaggc
acttcctgcctcaggtattgctggacagcccaggtgggtccctggcctttgtattctatt
tgactttaagatggtgcaggagaatacaaaaaactatccgggcatggtggcgcgcgcctg
tagtcccagctactcgggaggctaaggcaggagaatcgcttgaacctgggaggcagaggt
tgcagtgagccaagatcgtgccactgcactccagcctgggagacagagcgagactccatc
ttaaaaaaaaataaaaaagagagatggtgcaggagagcattgggatccctcccaagact
gtgactgttgtctttttgctgtagagtgacacccgagatttgtgcttcttgataatagact
acctggggcctcacagcccagccctcttgtagggaaatcctgtcctaagancaagggctg
gagtccgttacgttgtagcttggggcattcttaaatgtcc >IGR3219a
agagatggtgcaggagagcattgggatccctcccaagactgtgactgttgtctttttgctg
tagagtgacacccgagatttgtgcttcttgataatagactacctggggcctcacagcccc
agccctcttgtagggaaatcctgtcctaagancaagggctggagtccgttacgttgtagct
tggggcattcttaaatgtcccagactttgtggagatccattgtccacctaagaattata
ggatgtttttggggtctgctgcttgttctcagcctgtgtctcatctgacattaggttcca
taatttagtctctgttaaatgaactaggatttcctttggcttgtacttaaactgcccctg
aggtgtccaaggtgcagcctctcactgtggttctgggcctcagcgcccagtctctctggt TABLE 5-continued tgcttctccccactcacagaatgtttggtctttgaattcttttcttttagggcctccttg
ttcttacacagccgagtgtccactgtgtgggcccagccaatgaagccacgtagcaaggatg
gagtgagttggctgggggcctcatcccaaagatgctgtcatactggatcaccctagttct
ctgagagctcagcaggcagacttggtgacagcttagctgaggcattgtctgtggcatgtg
ataggcccttgtatcctgtcgaaagctctgcattgggta >IGR3220a
cactgtgtggcccagccaatgaagccacgtagcaaggatggagtgagttggctgggggcc
tcatcccaaagatgctgtcatactggatcaccctagttctctgagagctcagcaggcaga
cttggtgacagcttagctgaggcattgtctgtggcatgtgataggcccttgtatcctgtc
gaaagctctgcattgggtactctagacagtgcttacttagtcaccggtttagactggcc
ccagctgatctcagttcatcccttgagtgccttctgcctgtttggcttctgactggagcg
tgcctggggctagaatgagggacgagagagaggaggtggcngaggcactattcttgcctg
tgggtagctcgtactctgagattgctgcttcatattggcagctggccatgtgccagggga
ggagcccggctgtgagtgctcatcaaaggaagagactacgtgggtgcagctctgaggaat
gagtcggttgagggaatctagggtctcctcatttcctaagaaggcctcccttttttcactc
tgccctcccacatccttgggagggtctgagactggaagcaaggccttggctgatgtgtgg
ccacgctggctgatagtgtgcagagggctaggaggtgtgtccctggctcctggggtctgt
caagagtttactattatgcagatggaagttggcaggaaaa >IGR3221a
gggtctcctcatttcctaagaaggcctccttttttcactctgccctcccacatccttggg
agggtctgagactggaagcaaggccttggctgatgtgtggccacgctggctgatagtgtg
cagagggctaggaggtgtgtccctggctcctggggtctgtcaagagtttactattatgca
gatggaagttggcaggaaaagctgtgatgcaagtacatgcaagcccagcagagtgctgga
gtgagagttaaacttcgggaaagttgctcacatctagcaatttggacatttgaagttcct
tagggtaagacatcagcctgtcctagagcaaagagggctggaaggtcctgtggtctgtgg
gctttgtgttacggacatggaatgagagatagaaagacagtttttttttttttttttttt
tcctcanagcagagganaatgaaaagtctggatgatttactggagccctanaananagtt
cttgttcagctggtgtcattgcagggcanaggattaagtgtttgggtagagtgctctcca
gctcagatggaatctatctgagcctggtaacaggccagcatctgctctggacctttcagg
aagtgcttcttagagtgtggcctgttttgtacctggcactctgagggccagggtgtagt
ggagatcctcaggcctgggtacttgtaggagcctggaatg >IGR3222a
gcagggcanaggattaagtgtttgggtagagtgctctccagctcagatggaatctatctg
agcctggtaacaggccagcatctgctctggacctttcaggaagtgcttcttagagtgtg
gcctgttttgtacctggcactctgagggccagggtgtagtggagatcctcaggcctgggt
acttgtaggagcctggaatgagcaggtcagaggcatataagtacatgagttcctagagta
ttggtccaatcccccgccttttgctagagaacattgcttgatgagctttagagccagtg
attgaccagttccaggggttatcccctgatgatcaatgtactacattatacctgattccag
tctctcctgaattaaatgttttcatttcttgtggtgctcctggaacatggagatcgcccaa
tttctgccttgtttgcatcttcactgttcccagtctggaccttctttctcacccaggaa
tcagctgacttgggctgggcagctggctgcctcaggtccactgatgtttctctggtgccc
ttggtactaatgattgacataaattatgcctagtgcagggctacctgccaacatctgtca
tcacattcagtcctccaacagcccatgagatataggtcctagtattgtctctattatat
acatggggaaactgaggaatcctataacttgtccaaggtc >IGR3223a
agctggctgcctcaggtccactgatgtttctctggtgcccttggtactaatgattgacat
aaattatgcctagtgcagggctacctgccaacatctgtcatcacattcagtcctccaaca
gcccatgagatataggtcctagtattgtctctattatacatggggaaactgaggaat
cctataacttgtccaaggtcacaaagccgggaagtggtatagaattgggtttaactctt
agtatgtctgaccctagggcaggtgtgcctgtccatttgactgtactgccttgccctgag
ctggactggctggttatttgtgagtgctgtcatgtctaaggtaggagtgactgcccatct
gaacttaagggaccatgttgctgttttctgggtccatgttgcgttcctccctctggtgag
atccagccaggcgtgtcatggacctgctttatgaacctttggtgtaacccatgataaagt
ccttaacctgggcaggcatgttcttcctgggcaaagtgtggcttccctgtttgggagtcc
attgcactttaaggtaacagattattgagtaggactggatagctgcaatatctagcagag
tgtgttttgggtttgactcttggttctgtcattgatttgctgtcagatgtcagatatgta
ggaaaccttctctcagcctcagctgtttgtcatttgtatc >IGR3224a
ttcttcctgggcaaagtgtggcttccctgtttgggagtccattgcactttaaggtaacag
attattgagtaggactggatagctgcaatatctagcagagtgtgttttgggtttgactct
tggttctgtcattgatttgctgtcagatgtcagatatgtaggaaaccttctctcagcctc
agctgtttgtcatttgtatctatcttatatctgaaatggaggtagttatctagcttagaa
ggtttgggtgagaattagatagtagaaatgaaagattttttggaaacaaatagtgcttatc
tcagactatgttcccaggaaacagcctgagacagagcttaagtacttaatgctttattgg
aagtgtaattgcagggcagccagggtgagggaaaacaaaagtgaggtgcaggcctgtgc
gatggctcatgcctataatcccagcactttgggaggtcgagatggatggattgcctgagg
tcaggagtttaagaccagctggccaatatggtgaaacccccatctctactaaaaatacaaa
aattagctgggcatggtggcacacacctgtagtccaagctactcaggaggctgaggcagg
agaatcccttgaacctgggaagtggaggttgcattgagccaatattgtgccactgcactc
cagcctgggcgacagagcgagactgtctcaaaaaaacaaa >IGR3225a
ggccaatatggtgaaacccccatctctactaaaaatacaaaaattagctgggcatggtggc
acacacctgtagtccaagctactcaggaggctgaggcaggagaatcccttgaacctggga TABLE 5-continued agtggaggttgcattgagccaatattgtgccactgcactccagcctgggcgacagagcga
gactgtctcaaaaaacaaagaaaaagtgaggtataaaggaggatgggaggtggtgtt
ttagcaagctggctactctgcacagagatgtacttggttaccctatgagggccctttggt
agccactggggaggccagtctggtacttcaacagagtctggagatagtgagaggagccag
agattctggcgtgggcctggatagtctcctccactgggctgaggcaaagtaaatacccctg
ggacctgggagatggtgagaccaagaggttgcaaggtgggacgtaagatgcatccaata
tagtggtatatggattttatcctcaagtgtagttccctttttgtgggttagtctcatccag
actgccaagtctctgccaagactatgactgaaaacccaacttggcttttgcatgtcagtt
ttaacagccttctctgctacttcattgtctagttactgaagcaagactttgtggtggtga
tggtacccaggtggggaagtggaagtcaaccactattcat >IGR3226a
cctcaagtgtagttccctttttgtgggttagtctcatccagactgccaagtctctgccaag
actatgactgaaaacccaacttggcttttgcatgtcagttttaacagccttctctgctac
ttcattgtctagttactgaagcaagactttgtggtggtgatggtacccaggtggggaagt
ggaagtcaaccactattcatgtaccagactgagaaagtatgtggatagatacagataaac
atcttggctttattaggttcttcgtgaaggagaatattttttcacataaagtagttgttg
aagatacgaaacctggcatggtgagatgaggctagagagggcagtagggcctggtcacac
actcaaaaggacccctttgggctaaagagtttgaactttatcttgacggcagtagagagcc
aaaggagggctttgataaaccatgctggctactttgtagagcagaggtgggaggaaggcc
agatgacatgtggagaggccagtgtagtggggccaggatgcctgtagggggaagttaggg
gtggctcagatcagggtgatgactgaggctaaggagagtagggtaccccccatacttgcc
tagggtgccgtggcagcagcttataggcctgaatggacatccatgtgctttggtggcagg
gtctcctggagcctctggatcctcttaggctgaacacaca >IGR3227a
agtgtagtgggggccaggatgcctgtaggggaagttaggggtggctcagatcagggtgat
gactgaggctaaggagagtagggtaccccccatacttgcctagggtgccgtggcagcagc
ttataggcctgaatggacatccatgtgctttggtggcagggtctcctggagcctctggat
cctcttaggctgaacacacaggtcctttcagccctgttatcctagagttggaggcagcgg
ggagccgtgtccagttaggttttcccccttcacagaaggcaggcaggttcttgttcagtg
ccaagcaagaccagtttgttctcagcaagctcatgttctgtctctaggctgttaaataca
ttgttaaaactcaggctgttgcatttgggttgcagctgggagcttggcagagattctgcc
tgatgaggtaaggagagaagctaaggacgctgctggtttgcagctggaaacatctttttca
tggccatttggccagattgtaaatgtcttttccaaagttcaggtttggtgggacctctgg
ttgtatgtcttggaattgccctgtgtttagaaacagtgccagtcgcctgatgggtgaatc
actgttgctgggatgttggcaggttttgcaggactttcctgtgggggtccaaacactagg
gctggcagggcccgtttggagtctgtttgagaagggcctg >IGR3228a
aaatgtcttttccaaagttcaggtttggtgggacctctggttgtatgtcttggaattgcc
ctgtgtttagaaacagtgccagtcgcctgatgggtgaatcactgttgctgggatgttggc
aggttttgcaggactttcctgtgggggtccaaacactagggctggcagggcccgttttgga
gtctgtttgagaagggcctgctttgttttctttacattttaagcatatgataaaataatt
ttaaaaattgctatagaatttcttgtagaaagattagagaaacaagcataaaaataaaaa
gaaattatttcaccaagatatagccagatgtatgactcttttcttgcatctctctatata
cacatatacattaattttttccttacaaaaatggaattatagagtgcatattattggggcc
cactttttctcacttaacagtatgcttagatctcttcatgttgatatatagtattcatttt
taatatactccataaaaactcattgtatagaagaaatgtaaaatcttctattgttgtagt
ttcctaatttgaacaagtctgtggtgaagtatttttttgttgtgttcctggtatgggacag
acattgttctaaaactctggggatgcagcacagataaaactcagtattggttttctgctca
agatgtcactttgttttttcataaaagtgggtttgacattg >IGR3229a
cattgtatagaagaaatgtaaaatcttctattgttgtagtttcctaatttgaacaagtct
gtggtgaagtatttttttgttgtgttcctggtatgggacagacattgttctaaaactctggg
gatgcagcacagataaaactcagtattggttttctgctcaagatgtcactttgttttttca
taaaagtgggtttgacattgttcacctccagacttattccagttggattctgagggtttc
tgggagggcttttagcagcactggacactttgtaggggcactcagcaggtacacatactt
tcacctactctgtcttaagcaagctgtgggcatagttatgagatgggttggaggttggcc
tttcccacattgtggggcacagtccctctcggatgctgcctcctcccaatctgactcta
ttagaggactttttgtacagagccttttgagttaagggggcccaggcttgggagaaatggg
gtagggctccagagtacccctgccagagatgtcagtgttgatgtggtagtctgggagctg
ctgcttggaggtgcccagctctccaggctagcagagttagttatccccttctcccaccag
agcaagactttgcaggctcttggtaggtaagtcatctgtaattacctgtgattctttgag
gctctgcccaaaccccatctgtgattctttgaggctctgc >IGR3230a
tgccagagatgtcagtgttgatgtggtagtctgggagctgctgcttggaggtgcccagct
ctccaggctagcagagttagttatccccttctcccaccagagcaagactttgcaggctct
tggtaggtaagtcatctgtaattacctgtgattctttgaggctctgcccaaaccccatct
gtgattctttgaggctctgcccaaaccctatctgtgattctttgaggctctgcctccagg
ctgagattcaagaatgggctcagtctaagccagatcgcacattccagagaaatcacagct
ggtattcatgtaataagaaacctggctttccctgagtgttgtgaggtatgaaccgtaga
tgataggagcagaatgatttgaaaggaatggacagacttcctccctggaatttatctggc
ctctaaaaaggtatgcaactgcaactggagacacacctgggtagagatgctgggttcccc
acttccaaccatgtctggtttggaacctgcctgggccctgttctcccaccaccccagctc TABLE 5-continued tgaggagcagtcagctggtcccttctgatcacagatacatcctcccagctctatgtttt
cactgtcccctccctacatacatacagaaggtgctgagcctgagccagtcaagccttttg
aggaacaagaaacagacacccaatcccttaggtataaggg >IGR3231a
tggaacctgcctgggccctgttctccaccacccccagctctgaggagcagtcagctggtc
cctttctgatcacagatacatcctcccagctctatgttttcactgtcccctccctacata
catacagaaggtgctgagcctgagccagtcaagccttttgaggaacaagaaacagacacc
caatcccttaggtataaggggcttgtgtaagcaagagagaagccttctgaaatcctggga
tagagaagacagtatagtaaggccttggagcagacctgtggctagaaccaggagggcctg
gactctgcctcagggcaagcccaggcttactcactttctcttgatgacttgntctcttct
gctgctctaactccctaatggaccccttagcacaatacgccctaccctgcagcaggttcc
aggttgaagataattgtcctgtgtgtcttgggacccccacacctagactatgacaggaa
gactgtcagctctgcagacatttggcataggcatgaacacatggcgccattcacttatgc
tttccttctgatagaggatccatttgcagatgggagttgtggttggccttctctgagcct
aacctggaatctcaatggattaggatttcttctgaaagagtaagatgaggaatggtgggt
gtgctgtgtgtctaatcaagtatggcgggcaaaaactga >IGR3232a
tttggcataggcatgaacacatggcgccattcacttatgctttccttctgatagaggatc
catttgcagatgggagttgtggttggccttctctgagcctaacctggaatctcaatggat
taggatttcttctgaaagagtaagatgaggaatggtgggtgtgctgtgtgtctaatcaag
tatggcgggcaaaaactgatgaactggcattatcttagacttagaattctgtcagataa
ggcttatgttttttgggaaagcatttgtatttcctttgttttgcttgctttgtcttagt
gaatttccatttgagcactccagtggggtgctcaaaagcanggcaggaagaagaccggca
gagctggggtacagatgggtgctaatcctccagcacagtctaggctgcatggctgagctg
ggagacggtatcggaggcttctgttgtggactgaggtttactgccagtgggtttgtctc
aggttgtgcctattctgggctgatgagaagacagtagctggcccctttcccatgtcagc
agcccagcctgaggttttggccatgtgtgccatattcattttgtatcctgagtgcctag
atcagtgcctggcatctgcaggtcttcagtaaatatttgtgaatgaatggtgacgggcca
gtgagaacagtgtctgccaaggagccttactacaggaaga >IGR3233a
ctgatgagaagacagtagctggccccctttcccatgtcagcagcccagcctgaggttttgg
ccatgtgtgccatattcattttgtatcctgagtgcctagatcagtgcctggcatctgca
ggtcttcagtaaatatttgtgaatgaatggtgacgggccagtgagaacagtgtctgccaa
ggagccttactacaggaagaactgtctacctaggagactgtctcctctgactgctctt
tctctggcaggtgcagactgacaagggttagttttattcctcttctggctggccatctgt
tgtacaccttagtttgggtgttggtactctggaggatattgtgtcaaattatctttctgt
tattgtctctcatgtactgttgcctccttgtgggcagggactggttcccaaaacctggc
actgtcctggcatatgtgttggaaggtaagatagaaacaaacagcagtctgtgaaataag
aaggagtgggccagaatcttggactgacagaccattggaacccgagctgactgtaccca
ctgcgattccgccttctcatggtacaggtggttgctgggagttgagaggatgggctctct
ccgcagggcacgtgacttcccagagcagggaccagaattgagcacacatcactggctgca
cgctctttgttctttctgctgtttgtccttttagcttct >IGR3234a
ggactgacagaccattggaacccgagctgactgtaccccactgcgattccgccttctcat
ggtacaggtggttgctgggagttgagaggatgggctctctccgcagggcacgtgacttcc
cagagcagggaccagaattgagcacacatcactggctgcacgctctttgttctttctgct
gtttgtccttttagcttctgtgtgctaggccaggattttgatatgtttgattatctgca
tatgtgtgtacatgcctatgtgtctcctcacctaaattagtcttttcactttnttgatc
cagtgattgtcattgaatgcctttcagacacttccctctgtgaccatgaaactctgggtg
tctgcattgctgatggcctggtttggtgtcctgagctgtgtgcaggccgaattcttcacc
tctattggtacgtgccaacaggactgtcgtctccctgacaccttgnctcacatgccacgg
atgtctctggctgcagcctgttctcatttagagtgggatagccttaactactggttttgg
ccagttctgaggagagtggaactggcagagttgctgttttccctataagatcccaatga
tctggatgttcaggagccagatgtctgaattgggtctttcttcctgggaagtgcaggct
gcacttgggctctctggtctttttgaccaccttgcccatg >IGR3235a
ttctcatttagagtgggatagccttaactactggttttggccagttctgaggagagtgga
actggcagagttgctgttttccctataagatcccaatgatctggatgttcaggagccca
gatgtctgaattgggtctttcttcctgggaagtgcaggctgcacttgggctctctggtct
ttttgaccaccttgcccatggaccagagagtggttctgagcagcaaatcctttgtatcct
gaggatcaagcttttcctatccttccgacctaaagttcagagctttttatcctgtggtga
gccccaggatatccatgcccagtgtcatgaccagctatgtaacagtcggagaatgaga
tttagggctgcttcttgagtgacatccagtgcacttatctcaaacatccccttggtgcct
ctgcctctttcttcctgaagttgcgagatagagcccatgagtgcctaggccccctttaa
ctccaagtcccataatccncagagagctgacatgttcttatcccaggggacttgcttct
gtgctggtattcnnngcccaaggaaggaggctggacatccctcatctgttttctcactgg
tgtctttcttctctcccttgcagggcacatgactgacctgatttatgcagagaaagagct
ggtgcagtctctgaaagagtacatccttgtggaggaagcc >IGR3236a
cagagagctgacatgttcttatcccaggggacttgcttctgtgctggtattcnnngcccc
aaggaaggaggctggacatccctcatctgttttctcactggtgtctttcttctctcccttg
cagggcacatgactgacctgatttatgcagagaaagagctggtgcagtctctgaaagagt
acatccttgtggaggaagccaagctttccaagattaagaggtgtcctaagtccccancca TABLE 5-continued tccttagttggccttccttcccttctgcccctcaaggaacaaggaagccatccaggntgc
ctataagaggaaacctttgagaggntgatgtggggctggcctggtnncttcatgccagtg
cttgagaggagctaagtacatgggctaaggagtcactgtttatttttntatttaagacctn
ttcccttacattggggtcccagctgttatctagattaagggtagaagtatctgtggg
gagttactgtattcattttcattgcctcttgatgaaaagggccccagaacctggcacca
gggaattctcactaggaaaattgtcacaggtcaagacctatgtgggtggacgcattagtc
ttccttttcctctggttccacagctgggccaacaaaatggaagccttgactagcaagtca
gctgctgatgctgagggctacctggctcaccctgtgaatg >IGR3237a
cattgcctcttgatgaaaagggccccagaacctggcaccagggaattctcactaggaaaa
ttgtcacaggtcaagacctatgtgggtggacgcattagtcttccttttcctctggttcca
cagctgggccaacaaaatggaagccttgactagcaagtcagctgctgatgctgagggcta
cctggctcaccctgtgaatgcctacaaactggtgaagcggctaaacacagactggcctgc
gctggaggaccttgtcctgcaggactcagctgcaggtgagggacggtgagcaggtgcttg
agtgagcccatatgtttgtgtgctcatgcctgggttgttgtgtctgagcctgtcttgggt
ctgggtgttggtgggcaagtacattgtggaaacaggaccctgctggtctcatggctctct
cccttctctgtggggacctggaagttggctggccttggtttttaacatgtaatgatgttc
agttctttttttagcgtctttttttagtgtctgtcttttcttattttttgctaatgaca
tttttccaattatactttagtgatacatgtttatagaaaagtcggaaaacacaaaaacaa
gagaattataattcttaatccagttgcccagtggtgagcattattaaaattgtagttttt
ctacctatgcatatacatttaaaaaatggaactatacata >IGR3238a
ttttttagtgtctgtcttttcttattttttgctaatgacattttttccaattatactttag
tgatacatgtttatagaaaagtcggaaaacacaaaaacaagagaattataattcttaatc
cagttgcccagtggtgagcattattaaaattgtagttttttctacctatgcatatacattt
aaaaaatggaactatacatacataccagggcatgcaaactcagttgcttggagggacaat
gaatttacaagtgtcaagtgggctggatggtggggccagggcaagttggggagcataggt
ctgatctaaattcattcctattcatatgttttacaaacaaagcatatctgttggtagatt
tgtgacagaagaaaaattctgtgaatttctcagcttctttatatgccattcaatgttct
tctgcaacatgattttaatggctggatggtgattacctgtcagatggtgataatctgtca
tactgataatactgtcaaatgggtcaagtcattggatatgggattttttctgaattatca
gcacctttttacatatttcttggtgtatacttctgattactttttttagggtaagttccta
gaagtgatattaccgatgagagtgtgaacttttttaaaagctttaaactatacttggtgct
tttattgtgataatacttttttatgccctaatactttttctg >IGR3239a
gggtcaagtcattggatatgggattttttctgaattatcagcacctttttacatatttct
tggtgtatacttctgattactttttttagggtaagttcctagaagtgatattaccgatgag
agtgtgaacttttttaaaagctttaaactatacttggtgcttttattgtgataatacttt
tatgccctaatactttttctgtcaataagaagagatggtacggtgggcctggaggtgggct
ctcctaactcctagccctgggtttagtcccctggactcactgactttttttttttttttt
tttttttttgagactgagtctcactctgtcaccaggctggagtgtagtggcgggatctcgg
ctcactgcaaccttctgcctccgggttcaagcaattcttctgcctcagcctcctgactagc
tgggactataggcacatgccaccatgcccagctaattttttttttggtatttttagtagag
acaggggtttcaccatgttggctaggatgttcttgatctcttgacctcgtgatccacccat
ctccacctcccaaagtgctgggattacaggtgtgagccaccatgcccgctgcctttttttt
tttttttttttttttttttnnnnnnnnnaagggacagggtctcnctatnttancctanactgg
agtgcagnggctattcacaggtgcgattgtagcacactgc >IGR3240a
ctaggatgttcttgatctcttgacctcgtgatccacccatctccacctcccaaagtgctg
ggattacaggtgtgagccaccatgcccgctgccttttttttttttttttttttttttnnnn
nnnnnaagggacagggtctcnctatnttancctanactggagtgcagnggctattcacag
gtgcgattgtagcacactgcaaccttggactnctggcctcacgtgatcctcctgcctcag
cctcctgagtagctgggactataggcacagtgccattgtacccagctnttcactgcctnt
tttccntgagctgngagtgctgattaacttcanactagctgtctctctggctganacatt
ttanccatgtggccanactgggttgggcctgggggcagggtggcctctggananggggatt
ggtgagctcanccaggctggagctgtgcccagtgagctcactgcctccanaaaccacggn
tgcctttcccanactcccgcctntccgcctgggcctgcagctcgggacaggctgttctgc
ctgcacggnaggagactaagcctacccagatgacctcctctctccaatcttgttctcaca
ccctacactccaccatcatntggttcctttggaaaacctnntgattacctggaaggagat
agggcaggcccagagaataattggtngnnttcatctctga >IGR3241a
ctntccgcctgggcctgcagctcgggacaggctgttctgcctgcacggnaggagactaag
cctacccagatgacctcctctctccaatcttgttctcacaccctacactccaccatcatn
tggttcctttggaaaacctnntgattacctggaaggagatagggcaggcccagagaataa
ttggtngnnttcatctctgactttgagttcttgccctgaaacgagcagggcatgctgac
agtgtgcttttcctggcagcatgttccctactcccaccccaccagattntaaactctt
tagagtccctgaccatgtagctatgaagacaaggaaggcagggttacagcttcttggtcc
ctgtccccagttatgctgaagtggatgtttaggtctgaagtcataggtggcagtggata
cagctactcttgggaagaggttggggaaggaatggccttgttgttcccctctcacttctc
agcttagaggcagaattgaaggcccctaagtcagcctgggaaggcttggctcccacctggg
attgtaggaggtacacatcttactttacagctagggcttggagtcccagaaaagcctcct
tggagtacttctgtggtcaaaagctctcccacgcttcaggctgtggtcttgagcaccata
actggagagcccatgccctgaactcattgaaggtctgagt TABLE 5-continued >IGR3242a
ggccctaagtcagcctgggaaggcttggctcccacctgggattgtaggaggtacacatct
tactttacagctagggcttggagtcccagaaaagcctccttggagtacttctgtggtcaa
aagctctcccacgcttcaggctgtggtcttgagccaccataactggagagcccatgccctg
aactcattgaaggtctgagtggtgggagtacagaggagaacagncccaccgtggtctctt
aggggacggaccttgctggttggtgcaaccccaccttggtccttggcctgtctaggtgg
tccttcagctgtcaacctaggggaggggggatgacttccaggactttcatcatcacctt
ctggatgataagtgccagtggtcagtaatgagtggccagctcggcttcattagttaactg
tcattgtcccttggactcctcaacttgaaatgtgtgctggaagtctgtgtttacctgact
agcccaattaccctggatcaaggtttttccatgggatttattttccactgagtggttgaca
gttcttcctgagtcctctcccgtgctcttctcagttaccctctctatcctctgtttcttc
tgtctccaccagctctgactgaatgatttggagccaagacttctggactcctaaatatta
accaatatgggggctgcttctacttagttccaaagagca >IGR3243a
aggttttccatgggatttattttccactgagtggttgacagttcttcctgagtcctctcc
cgtgctcttctcagttaccctctctatcctctgtttcttctgtctccaccagctctgact
gaatgatttggagccaagacttctggactcctaaatattaaccaatatgggggctgctt
ctacttagttccaaagagcaacacaggcagtaggtatggtgaggagtaagaaaggaaaag
tccccatagactggagtcatcagggacaacttcctggtggaaggggggcaacagcctttga
ggggaggggcggggaaattcactagccagagaccctctttgtggctgcctctctggtcc
caagtggaattctgcccctggatcaagggtaatctcttgttctgactctcatttggaagg
ttttatcgccaacctctctgtgcagcggcagttcttcccactgatgaggacgagatagg
agctgccaaagcctgatgagacttcaggacacatacaggctggacccaggcacaatttc
cagaggggaacttccaggtaactcaccactccaggcgttgcctgtcccgcntgtgtctct
ttagtggcgggacaggttggagccaccaccaacttgtggcctttaacctcgggtgcacct
ctggtgcacctcttggctcaccagtttgtgctggactccc >IGR3244a
gacttcaggacacatacaggctggacccaggcacaatttccagaggggaacttccaggta
actcaccactccaggcgttgcctgtcccgcntgtgtctctttagtggcgggacaggttgg
agccaccaccaacttgtggcctttaacctcgggtgcacctctggtgcacctcttggctca
ccagtttgtgctggactccctctcccatgacaggtttctccctcagccctgccctgcca
cctccctccatgtattagccaaggcctctcctcttgcatctcagagaaagccaaagttg
ctgctcaggaaccccctccacgtctgtccccagagcaccacacagatctgcattcagacc
tgcttcttgtctcccaccctccaatgtcttttcatctaaggctgatctgggcttactatc
ccctgtcttgagtcctcttagttacagtctctgctcctatacattctgtctccacctct
ctgggttctacccttgagctcccatataggctctattcttgctcatcttaacacttgcct
ccctcggtatctgagagtctttcgagtctttgctgctgattcatctcttctcccctcctg
gttaggctactggatagagtaatctacactctgtccattttcctggttcccatatactcc
tgaactcacagtatctggccttttccccactgtcactga 22 IGR3245a
cccatataggctctattcttgctcatcttaacacttgcctccctcggtatctgagagtct
ttcgagtctttgctgctgattcatctcttctcccctcctggttaggctactggatagagt
aatctacactctgtccattttcctggttcccatatactccgaactcacagtatctggcc
tttttccccactgtcactgatgctgttcttacaaggtcatcagtggcngcttggctggta
aacccagcgaacaaggttcacacataatgttctttaacttcccagcagcatttgacagat
agattgcctcattctttgtgatgttctctcctccttgaattctggcatactgatatctg
cttctcttttagcctctctggtcatttctctcaagtgccccctctcccactgacttccc
agtgttagtgtttataagaagatgttttgagggctgctggagacaagtaaccccagcgat
tcactgtgtgaggctcatgcagacccagcttattccagctccagaacctcagctgccccc
tttagactccattagagagagggcagttcagggcacctgcaagatctgttcactctgtag
ccttgagattggttgcttggaggagggaaccatacccggcgttgacctctcacgttcac
tcagcaaacccatgagtgtcctgaatagggttatgggca >IGR3246a
agacccagcttattccagctccagaacctcagctgccccctttagactccattagagaga
gggcagttcagggcacctgcaagatctgttcactctgtagccttgagattggttgcttgg
aggagggaaccatacccggcgttgacctctcacgttcactcagcaaacccatgagtgtc
ctgaatagggttatgggcagaaaggaattactccctaggactccatccttacctcatct
tctccctgagcaccttcccaggtgagcacagccatttccatcacctgaggtggatgca
tccagatctgtgtttcttgccaaggcttgtctcccgagcttctaaccagtgtagacggat
gcctttgggacatctgtacttgaatgtcccatggacttctcgaacttcatgtgtcctgaa
ctgaaatcctcatctccttgtaaacactttaccttcccctcatcctttctatctcagcaa
aaaggacctccatcctctggctgcctaagccagaagcctaaggcctatggattctacctc
cttctctcatgtcttccgtgcttatccctgactccagcctcacagctactttttttctca
atttgattatcaaaataccattctgacttgtctcctacctccagcttactgcttaagacc
atcctccatgtggtcttaagcacacatttgttcacatgag >IGR3247a
ctgcctaagccagaagcctaaggcctatggattctacctccttctctcatgtcttccgtg
cttatccctgactccagcctcacagctactttttttctcaatttgattatcaaaataccat
tctgacttgtctcctacctccagcttactgcttaagaccatcctccatgtggtcttaag
cacacatttgttcacatgagttcctgattactgtgcttaatttccaaagctaaaccccaaa
ctcctcctgtgtgtggtctttgggtcctgcatgactccattttcctggcttccttgccc
attgtactcagctttccctatcactcagctctttttgtctcaacccctctataggaatacc
tttacccatgtcagctaggctactccatgtctgattgcctatcagcactcagctcagctg
tcactctcccaaaatgctctccagggagtagacattcgagttggctctggggaggatgctg TABLE 5-continued agtgccagggagccattcttagcattcttggcatctgggagacatgttgataatagctac
tggtcattagcatcctggggagcataggagacatcttcatatgtcatcttattgaattct
tgccacaagctctttaaaattgatgatattatctttatttagagataaggggactgagac
ttagatatggtaacttgtctatagtcacacagctggttgg >IGR3248a
agcattcttggcatctgggagacatgttgataatagctactggtcattagcatcctgggg
agcataggagacatcttcatatgtcatcttattgaattcttgccacaagctctttaaaat
tgatgatattatctttatttagagataaggggactgagacttagatatggtaacttgtct
atagtcacacagctggttggcgccctagtgaggccaacacaaacctagtttagttcagct
ccagagcccagctcagtcagctatgttactctgccccagcaatgtaggttcctgggcct
gcagagccagaggagacctgtggagaaggaaaaggggctccaggagcccccccagtccctg
gcctacctagggacttcatcttgtgtttactgtcccaacttcctattcctcgttattgg
ttcctgagccaccgggttagcagaccctggtctctgaagcatttagcctactgtgtagt
ggtttcattccaggcagaaagagccttctctgagttcttttgtgtcagccatgcccaggt
tgctgttaatgggctgtggggagtcttccttgctttccagggagagtcacagcccccac
ttccccctccatggtatctgctttctcattattctctgaggaaccacacacatagtctttc
ccatcttgagctcaccctaaatcctgcatctccctatagc >IGR3249a
gagccttctctgagttcttttgtgtcagccatgcccaggttgctgttaatgggctgtgg
ggagtcttccttgctttccagggagagtcacagcccccacttcccctccatggtatctgc
tttctcattattctctgaggaaccacacacatagtctttcccatcttgagctcaccctaa
atcctgcatctccctatagctgcttcttcatattggcttgaaactatcttcatggtcact
ttccagcactccctctacagcagatgacctttggtcataagaccactgaactgatactc
agcaaggtccctgccacttaacagccaaagctggcactgcaaccttggctcttggcctcc
cttggtgtctctcacaccactcccgctccctctgtttctcctatctttagttcattctca
gggttattcattgtctgttctttctgggtaggtgctccctggagctctggccttagtcat
cttctccattctttcctmagagttcctgcaagctattttcctcacccatggcttggttgc
cacctaaatttatgttttttatattcagctaattttttccatcctctagactcatatggca
aactgcccaccagacatcttctctgtggtccacaggaccttcccactgtcctcaaca
atgcttcctggtgggtttctggggctccccctaaaaaggc >IGR3250a
agttcctgcaagctattttcctcacccatggcttggttgccacctaaatttatgttttt
atattcagctaattttttccatcctctagactcatatggcaaactgcccaccagacatctt
cttctctgtggtccacaggaccttcccactgtcctcaacaatgcttcctggtgggtttct
ggggctccccctaaaaaggccccttcccacttgggagatggggaatctgaggctaagagg
tggctgtgaaccccagtccagggcagggctgggccatctgtctgtgctcactgtgtcagt
ggcccttaggatatgcagtctaaatgtccgatggagttctgcttggtgatgcccctat
ccagtggctcaggctttccttgaagngggaatctcttcccctaatccagaggctctttgg
agcctgacaatttacttcccctgctgtaggaaccaagtaccaggcaatgctgagtgtgga
tgactgctttgggatggccgctcggcntacaatgaagggactattatcatacggtgttg
tggatggagcaggtgctaaagcagcttgatgccggggaggaggccaccacaaccaagtca
caggtgctggactacctcagctatgctgtcttccagttgggtgatctgcaccgtgccctg
gagctcacccgccgcctgctctcccttggtaaggagattc >IGR3251a
ctcggcntacaatgaagggactattatcatacggtgttgtggatggagcaggtgctaaa
gcagcttgatgccggggaggaggccaccacaaccaagtcacaggtgctggactacctcag
ctatgctgtcttccagttgggtgatctgcaccgtgccctggagctcacccgccgcctgct
ctcccttggtaaggagattctaggggaaggtaagatggaatggagagtggnanaggaac
tgcactgtgctggcatctgcctgacccctctcctgggactgagtcagtttaccctgtcac
ttggccagtgactaatgccttactgactttaggaccagtccagcttcttactagctcctt
acccacctcaatcctggccttaggtttgcgcagtcgctgatagatacgctcaggcctgtg
gcacttgtgggccttttaataaggactctgttatggtgtatctgtcaccatgcaggact
acacagggtggaacctttactacatcaggagcagctcaggagtcaggttgtactttagga
ttgttacagtgacaaacagtagcggtgctattagaggcctgaggtctaatagtaggactt
catatggcattgatactttgtgtgccttgtgctgttggactgaagaaggccaaaagcact
gtgccttaaaactcatctaccttttttttttttttttt >IGR3252a
tacatcaggagcagctcaggagtcaggttgtactttaggattgttacagtgacaaacagt
agcggtgctattagaggcctgaggtctaatagtaggactttcatatggcattgatactttg
tgtgccttgtgctgttggactgaagaaggccaaaagcactgtgccttaaaactcatcta
ccttttttttttttttttttgagacagagtctcactcatcccagcctggagagcagtggc
acgatctcagctcactgtaacctccgcctcccgggttgatgagatttttcctgcctcagcc
tcccaggtggctgggattacagaggcacatgccccatgttgtattttctttagtagagat
gaggttttaccatgttggtcaggctggtctcgaactcgtgacctcacgtgatccacccgc
ctcggcctcccaaagtgctgggattgcaggtatgagccaccgcacctggcctctgttggt
tttccagttacgaccagctactctggttagatgctgtggaaggtagaatgcagcatgca
ggtgagctgctgggagagaaacccttacagaataattctctaaatgacctaacagatgt
ttgtggtttccttttccttctcattccttgcattttctagacccaagccacgaacgagct
ggagggaatctgcggtactttgagcagttattggaggaag >IGR3253a
actctggttagatgctgtggaaggtagaatgcagcatgcaggtgagctgctgggagagaa
acccttacagaataattctctaaatgacctaacagatgttttgtggtttccttttccttc
tcattccttgcattttctagacccaagccacgaacgagctggagggaatctgcggtactt TABLE 5-continued tgagcagttattggaggaagagagagaaaaaacgttaacaaatcagacagaagctgagct
agcaaccccagaaggcatctatgagaggcctgtggactacctgcctgagagggatgttta
cgagagcctctgtcgtggggagggtgtcaaactggtgagatgtgtgaggggctagggtg
ccaaagctgtggacctggactctggctctgggcaggcagatttgggaaggtgttcttta
ttctgtaggtacttttctcagtatatcccccagttttttcatggcatctcctgaggctgac
atgtggatattctctgaggtgtaggaaaggagactctctcccctcgtgcccaggtagag
tgttgctcctctaagttaccagtgagctcgcctccttaccccaatatgtcccactttttg
cttcactcactgttgggaagaaaacaatgggtggacgtacctcaggccccaaaagaagtc
atggtataagtggagagtaagtctctgtggtaaagacacc >IGR3254a
gtaggaaaggagactctctcccctcgtgcccaggtagagtgttgctcctctaagttacc
agtgagctcgcctccttaccccaatatgtcccactttttgcttcactcactgttgggaag
aaaacaatgggtggacgtacctcaggccccaaaagaagtcatggtataagtggagagtaa
gtctctgtggtaaagacaccagcgtgtactagagcttggtatcgagcctttgagagccct
gggatcctagtgcttcctgaggaggcccaggtgtgacaggctctgagcctttccatgcc
cctgtctgcatggcttctactggctcctccaccaagaaaggtttctcccctgtcccagcc
cttcagacctactcaagtcttcacgaaaagggtcaggaattactttctgccatgggactt
gaggatgtgaggtgattttgggagagaagaaaaattgcatgatttgtgggtgttatttc
atgccagttaagctgaaggggctctcctctcctctccctccccattccccctctcc
tccctccccctccctccccctccccctccccccttctcctcctctctc
ctcccctccctccctcccttccttcttccttttcttctcttttttcctgtttcct
nnttttccttttnttttnctttctttcgtctcancctgtcg >IGR3255a
gctctcctctcctctccccctcccccattccccctctcctccccctccccctccc
ccctccccttcccctccccttctcctcctctctcctccccctccctccctcccctt
ccttccttccttccttttcttctcttttttcctgtttcctnnttttccttttntttncttt
tctttcgtctcancctgtcgcccaggctggtgtgcagtggtataatcatagctcactgca
gctttgacctcccagccttgagcaatcctcctgcctcagtctcctgagtagctgggacta
caggtatgcaccatcatgcctggctaatttttagagacaggtctatgtcatctaggctg
gtcccaaactcctggtctcaagctatcctttggccccncagagttctcggattacaggca
tgagccactgtgcatgcccacctgctgggacttttgttttcttctgtggtgtggtgggag
ggagcagctgctggccatgaggtgagtccagtgtctgcagacagccagactgggaccgag
gattaggactcactcagctcagggcctgttactctgtgctttccagacaccccgtagaca
gaagaggcttttctgtaggtaccaccatggcaacagggcccacagctgctcattgcccc
cttcaaagaggaggacgagtgggacagcccgcacatcgtc >IGR3256a
ggtgagtccagtgtctgcagacagccagactgggaccgaggattaggactcactcagctc
agggcctgttactctgtgctttccagacaccccgtagacagaagaggcttttctgtaggt
accaccatggcaacagggcccacagctgctcattgccccttcaaagaggaggacgagt
gggacagcccgcacatcgtcaggtactacgatgtcatgtctgatgaggaaatcgagagga
tcaaggagatcgcaaaacctaaagtaggtgtcactgtaggtccttctcgggtcactgaag
ggggaaggtcctttttctcatccctagcactatgggtggttggtttgcccatctagccac
cctttatccatatctagcatgggcctaccgtggggatacagagatgcttcagactcagcc
tgaccttgtgagttcatggtccagtggaagaagaacagggtaaccaatgtggacagccaa
gtgctatcatagaagtcacgctgggaacagggcaggtctacactggtgtgtcagttcac
ctggttgggagactggtgcgtgggtgagttttttggaaatgttccataggatgctatgaa
gctgggtcctgtggagctcctgattaggactgtaaatgaggtgaatgacttagaggagaa
tgtatatctttataatattgggtcttctcatccaagggca >IGR3257a
gctgggaacagggcaggtctacactggtgtgtcagttcacctggttgggagactggtgcg
tgggtgagttttttggaaatgttccataggatgctatgaagctgggtcctgtggagctcc
tgattaggactgtaaatgaggtgaatgacttagaggagaatgtatatctttataatattg
ggtcttctcatccaagggcatgacaggtctctccatatctttttaagttttcttcatata
agccttgaacatttcttaagtttattccttggtagtttctttgttactgttaatttactt
tatttcttcattattatttttaactggttacattattttattagtttactattatatgcc
aaactattgattttacaaatacatttcatagtaagagctaatgtttactgaattcttaac
tgtggcaggaacttctaagtgcttaacatatatattaagtgttatgtcacagttatgaac
agctgctcataatgatgtcactgtctctgttttacctatgaaaaagcaaactcatacaga
ttgcagctagtggttgaatttacttatttctttttttggttttttagctgatttctctttgg
ttgcctggatagcattaacacctggaaataaggaaaattttattttctcctgatacttgt
agttcctttgtttttataaccttattgaattgcccagaac >IGR3258a
ctgtctctgttttacctatgaaaaagcaaactcatacagattgcagctagtggttgaatt
tacttatttctttttttggttttttagctgatttctctttggttgcctggatagcattaaca
cctggaaataaggaaaattttattttctcctgatacttgtagttcctttgtttttataac
cttattgaattgcccagaacttctagagcataattacgtagaataggcatccttgtctca
ttcctgaatttcctggaaattcctatggtattttactgctaagaatgcagttggctgttg
gttttgtatatgccatgtttttaaaattattcttctgtttctagttcataaaagatttg
ttccccatttgacatctttcaaagagacctatttgctgccatatcccatcactgatgatt
gggaggggaggatttagctcgattctctattgctctgctcctaatagaattgtagggccg
aggtgaccaggaggcccgacactcatggagagacctgaaataggttcctatcctggcccc
tggacctcatccttggaacagctttggcttgaggtactaggacatctagggctttgagtca
gtggttggcatcatcgatgtggctgaggaaggggggctagccagatatatggagaatgggg
actaggactccccttttctactcagctccagagtcctccag TABLE 5-continued >IGR3259a
actcatggagagacctgaaataggttcctatcctggcccctggacctcatcttggaacag
ctttggcttgaggtactaggacatctagggctttgagtcagtggttggcatcatcgatgt
ggctgaggaaggggcagccagatatatggagaatggggactaggactcccctttctac
tcagctccagagtcctccaggaaagaaaactactttgttggttgtgccaggatttcctga
gagatttcttacccgttcttcagttccagacactgagaacatttctctgtgcatgtgtgc
atatgtgtacacatgtgtgtggctggccagngggtagtgttaggaaaagatatatttgaa
tagaagccatgcaaagagccaaacaaggttggcaaacatgtttggctcttaacatggctt
ctattcaaagataagctgacccctcctttccggagactgtgagggacagatgctattctg
gctttgaagtagagccaatgagcttaacttggcctgtggggaatgcctggcagctgtctg
tggggtctctggcctgctttcaaaatagcctgtgcttccctggggcagagcacagctg
ctcagagcctctttgtgggtgtcaggccaatgctgaggcacagatgtttggatgggtct
ggctgtggctgcagttttcagggagggactgacatgagct >IGR3260a
agcttaacttggcctgtggggaatgcctggcagctgtctgtggggtctctggcctgcttt
caaaatagcctgtgcttccctggggcagagcacagctgctcagagcctctttgtgggt
gtcaggccaatgctgaggcacagatgtttggatgggtctggctgtggctgcagttttca
gggagggactgacatgagctgaagctcaggaagggccatgagtaggagcttgggagccgt
ctgtcctgcttgtgctggccatcttaccagatcatgccatagcagcacagtgtccaagtt
ggtccatctcaccccttactagccttctggtccatctactcctctccatcccttctgcc
accacctggcccgggccaccatcatctcttgccctgacctctgtcgtggcctcactagcc
tcccagtccccactctggcccctcattagtcaactctccatgaggtattcacagtgatcc
attttacattcacattttgagtgtccctccctgcataaagccttcccattctcgttg
gccacaaggttgcatctagttcctagcccctgcttgtctcttcagcctgttctctcttac
tacttcccataaacctttaatccacacctactgcaacacccatttcattcccaggcctct
ggattgctgctctttccctgttcctgtaatgttcctctac >IGR3261a
gtgtccctcccctgcataaagccttcccatttctcgttggccacaaggttgcatctagt
tcctagcccctgcttgtctcttcagcctgttctctcttactacttcccataaacctttaat
ccacacctactgcaacacccatttcattcccaggcctctggattgctgctctttccctg
ttcctgtaatgttcctctacttggataactcatgttaaccttcaggcctcagctaggtg
gtctcctcccctaggaagctattcttgacactatacctnagcttccanaggatggtaag
ttcacccatgctgtgctgcagttacctgactggttttctgctttccccacttgactgagt
tgtaagagtgcaggggccatgtctcagttacctagcatagtgccaggcacaaagtaggca
ctcatcaatatttattgaaatcaaggggaagtgtgttggggtgggagtacctgggcctat
ggcccacccatgtgaggtcatgaggacagtccacagctgaagcacatggacctttgcca
tgttggctggctctgggcggcgagtccccttgggggtttcactaagcctaactgtggagg
ctgggggagatgaagtagatgcagggagtgcatgtgtagtgtgtacctgtatgagtgggt
ggcttccaggcagtggttcacttattttaacttacagaat >IGR3262a
atgaggacagtccacagctgaagcacatggacctttgccatgttggctggctctgggcgg
cgagtccccttgggggtttcactaagcctaactgtggaggctgggggagatgaagtagat
gcagggagtgcatgtgtagtgtgtacctgtatgagtgggtggcttccaggcagtggttca
cttattttaacttacagaatcttttcctggttttatcatctgacttgtaaggatcccaag
ggagcgaaaactgtgccatctgtctttgcttcttgaggctgtgggaacccagtgtgaggt
ggtgcagcaggagagtgttttggatgggtttcttggcagaggagcccactgaggttcggaa
ggatggtggaacttgactcaattgagagaagtacataaggcggaggctcaggcatggtgg
cacagtctgaaaatggtgggagtagctaagctcaggcaggctgtgctcaggcaggggtgg
tatgtgggcctggcaaggaaaggggctagtcaggcagatgcatgggtagacaaggcaggc
ataattctgcaggcaaagcggacctggggaggagaagggatgagcagtgaccgagcaggg
caatagccagnaactgattgcggattgggaatgtggaggcctcagactcttgccctcaac
tggcctgcaggatcttggggccttggctagagccattggc >IGR3263a
aggggctagtcaggcagatgcatgggtagacaaggcaggcataattctgcaggcaaagcg
gacctggggaggagaagggatgagcagtgaccgagcagggcaatagccagnaactgattg
cggattgggaatgtggaggcctcagactcttgccctcaactggcctgcaggatcttgggg
ccttggctagagccattggctgcaaagcttcctccactagcatggcagtaaatctgtcc
cagtgctctctgggaaaatattcaaggcaaaacaaacaaacaaacaaatcaagtcttccc
tctcctccttccttctagcttcacgagccaccgttcgtgatcccaagacaggagtcctc
actgtcgccagctaccgggtttccaaaaggtaagcaaagagcaggggttcgtagctgctc
aagcccaacttcaggacttctcagtgcctaccctagggatgggtggcttgccttttcct
gcctgctggcaccctcctcaccccccttgcagcaggcatcctgtactgcctgttcatgctgg
ccctgactctggggacagagttcaggacctcatgaagcctgcccttccgtcttcttttc
tctgcccttttcttttttgcccagctcctggctagaggaagatgatgaccctgttgtggcc
cgagtaaatcgtcggatgcagcatatcacagggttaacag >IGR3264a
cccccttgcagcaggcatcctgtactgcctgttcatgctggccctgactctggggacagag
ttcaggacctcatgaagcctgcccttccgtcttcttttctctgcccttttcttttttgcc
cagctcctggctagaggaagatgatgaccctgttgtggcccgagtaaatcgtcggatgca
gcatatcacagggttaacagtaaagactgcagaattgttacaggtacagatagtacctgg
gactgtaggagttgggaagtgggtatttgtggctagatggtctcacagggtgtccagaac
tgggccaagaggcccaactgtatgactactgcctgatgctatgaatatggagtgatctca
ttttaggaaaccagaattaatcatgcctgctggcttttcaacaattagtgttcaacaaata

TABLE 5-continued tctattgagcatctnctgtgtgcccaagtgtgctgcaagctagggatcaggggtagttat
ggtaggttcgttcatgtcttcttgacaacagaagctcaaatcctgaatggtctcagggac
atctctaagagagctaaaaatgacttcagaggccatggttctgtgtcataatcaaataca
tttgaaggtcaaagtattctgtgtgttttctcctgctgnaccacaactgaagttgctcca
aaagcagcagcagggggacttcccatgagggactgccaaga \>IGR3265a
cttgacaacagaagctcaaatcctgaatggtctcagggacatctctaagagagctaaaaa
tgacttcagaggccatggttctgtgtcataatcaaatacatttgaaggtcaaagtattct
gtgtgttttctcctgctgnaccacaactgaagttgctccaaaagcagcagcagggactt
cccatgagggactgccaagatggggtcagttgagaattcaaagaaagcggcactaaaccc
ctgggtcttcagtccacagcatttattagggaacttgcagagtgggctgcagcaatcctc
aaaatggacagcaagagacaagaattgtttttacctaagtatttccacagtgagggagtca
gagtgtggagtttatttgagggtttagggaatttggttcagggctggggctagtttcttt
cagtgttatgggcaacaacctaaacaccttcatcagtgcctgggaatgttgaagactcca
gcttgtgttccagcctgaagggaaaaacctgcagctggctgggtcacagagctgtcaagg
gagtctgattttcagtcagaacaaagaaagaaaggcggggtgggtctgggggaccttaca
ctgtgatatgtaggtggaagtgagaggcctggactggttaagctggtgcaggtggaatgt
tcttgtccaagtactcccactgggaccctggcttcctgcc \>IGR3266a
ggaaaaacctgcagctggctgggtcacagagctgtcaagggagtctgattttcagtcaga
acaaagaaagaaaggcggggtgggtctgggggaccttacactgtgatatgtaggtggaag
tgagaggcctggactggttaagctggtgcaggtggaatgttcttgtccaagtactcccac
tgggaccctggcttcctgcctttattcagaggtgattttgaagaaatgtggcagcaccct
gctgaaaggttttgggtaaagctccttattaaagtatcctcttgggtaaagcttagtaaa
gtgtcctcttgggtattgagtccaaatcagcactggctatgttcccttataaatattgga
acttctgtgttctgttgtaaaattgatgacctgagacaccntcagagaagtttcactggc
atctttctagaggcctctgggtctctctgtttggccaaagtttctgtatacttaaagata
gcagcctttacctttaggattggcatttgggtctgatctaccatagatctcattagaata
ttgattaaagatcatttggaaaagatttttttgaacttttgcttggacacgcctaagcaaa
tcagccttcttttgttgtttttctgtgtagctgcatcagcaattggaaaatcaattttt
gaaggtcatctttatggattggtgtgaagtctaccagagt \>IGR3267a
tggcatttgggtctgatctaccatagatctcattagaatattgattaaagatcatttgga
aaagatttttttgaacttttgcttggacacgcctaagcaaatcagccttcttttgttgtt
ttttctgtgtagctgcatcagcaattggaaaatcaattttgaaggtcatctttatggatt
ggtgtgaagtctaccagagttttaaaaagcatactgattaccttgcaaatagtactgtga
aatttttaatttttttttcagttcagctcaacttagtgtttgtaattttaaataaattc
tgcagataagcacatccatggaggacttctgcctcatctcccacttgctgcgtatgtgta
agagcaccaccatttcaagagtgataggcactcttgatgtgctagatgagtccctgttgg
cattgtcttgattcatatcttcttggagcaggtttttgttttgtttttaaagacatctg
ccactgcttcctctgtgttagagccagtcttcaggactttcatggtcctgatcaaagacc
acagtctgcttggctgatttcataccctggaccaagaggctgagtagacaggacctgtgg
ctctgttgctttcctggctagctgtgcggctgtactcactgtatccctgtcttacactca
cccgtggaagatagcagcttcttgcctatggactgacttc \>IGR3268a
gagccagtcttcaggactttcatggtcctgatcaaagaccacagtctgcttggctgattt
catacctggaccaagaggctgagtagacaggacctgtggctctgttgctttcctggcta
gctgtgcggctgtactcactgtatccctgtcttacactcacccgtggaagatagcagctt
cttgcctatggactgacttctctgctacaattcagcctttatcttgtctggcctctcatt
gtgttgtagctcaattgtctggggcccgaatgccagacctcttggtagagggggctcttat
agttaaggatcttctgaaattcagaccacagctgccaagtggttgagatgccattttg
tttgtattcttctcctaggaactgtctcgacatttccttttgccagtcagtggtattgaag
gctttgatccttcatggtctggggaacaggaacctgggtttcagcatgtatccctaagtg
cttactccatatgaaatgcttgtggtatgatacatgcctaggcaccagcaacagccctca
caccaggtcctttaggaaatgctgcaggcctctggaaaggagctggttcttctatctgtt
gacattctttcagctgtagctcacatgtttgctgtagatcatttgaaggaaaaaggtaat
tgaggctttctggtgaattggatgagggcttatctgatag \>IGR3269a
tgtggtatgatacatgcctaggcaccagcaacagccctcacaccaggtcctttaggaaat
gctgcaggcctctggaaaggagctggttcttctatctgttgacattctttcagctgtagc
tcacatgtttgctgtagatcatttgaaggaaaaaggtaattgaggctttctggtgaattg
gatgagggcttatctgatagagaggaagagatgctacacctctaggattctaaagattga
agactttggctgcatgatgtctcagcctcaccagaaaagtgatttctgacctttttaatt
ttgcctttactctgtccttagcattgtaaatacccacntctttcaaataactgacccac
tcttacaatagtaagtctaaagatttaagtgaatacctcctcacatgaatcggtcttgac
gtacagtttcttgttattaaaggcgtgagcctggggacttggatgtgcctggatagggaa
tcttactgctgcaaatctagatggtcctatgcattttgtacttatttgggaactgtatta
agaaagtaggtacggtggcttcagaaccataatcaaatataattctccaaacctaaaag
atgagccagctctcgcaatgcagcttctttcactgcctgggatttgtaaatttaagcaat
ccatttaacaagtggaagtattggaaaatgcagtcatact \>IGR3270a
atggtcctatgcattttgtacttatttgggaactgtattaaagaaagtaggtacggtggc
ttcagaaccataatcaaatataattctccaaacctaaaagatgagccagctctcgcaatg TABLE 5-continued cagcttctttcactgcctgggatttgtaaatttaagcaatccatttaacaagtggaagta
ttggaaaatgcagtcatactttgcagctccagcaacaagcactaattgaattttcctgag
tgtacctgcacagcagtcacagttgtgtttaaattttcttccatgccaggtgtcgtggc
ttacatctgtaactcagtacttggggagaccaaggcaggaggattgctcgaagccaggag
tttgagaccagtctgggcaacatagtgagactctgtctctaccccactcccccaaaaa
aaaggagagagaaaaaattttcttcaagctcttgactacaaaaagagatatgctttctc
agctgctctggcacttctctccttagatgcatctccagcttagggccacctgctgaacc
aggcttccttgtgctgttgacaggattccaggtattttggtacaggaatcttaaaggc
tgaagcaatggatgacaacatgttttcatccatgctttgtattaaaattttttattttgt
agacatggaaaatgatactgccaacattttgtgctctaat >IGR3271a
ccttagatgcatctccagcttagggccacctgctgaaccaggcttccttgtgctgttga
caggattccaggtattttggtacaggaatcttaaaggctgaagcaatggatgacaaca
tgttttcatccatgctttgtattaaaattttttattttgtagacatggaaaatgatactg
ccaacattttgtgctctaataagaggatttcatctctataaagtccactgtccctttct
ttcttgcattttcttttttttgtgtgtatgtgaaacagggtctcactctgttgcccaggctn
gagtgcagtggcacagtcatagctcagtgcaaccttgaactcctgtgctcaagcaatcct
ncctgcctcagcttcctgagtagctgggactacaggtgcacgccactgtgcccagctaat
tttttcattagtagagacagatgggtcttgctatgttgcccaggctggtctcaaacttc
tgagctcaagcagtcctctcacttcagcctcccaaagtgctgggattacaggcgtgagcc
aacacgcctggcttctgtcccacgtttttataggtctctgttattgctagttttgtagca
tctctcacctgactgttgggattgcagaaaaggatatacaaaaaataccaactttctgag
aacttatggcctagccccagaggtttttatgttttcagtg >IGR3272a
acttcagcctcccaaagtgctgggattacaggcgtgagccaacacgcctggcttctgtcc
cacgtttttataggtctctgttattgctagttttgtagcatctctcacctgactgttggg
attgcagaaaaggatatacaaaaaataccaacttctgagaacttatggcctagcccag
aggtttttatgttttcagtgagacacaatagccaactgttcccagatggacattggtggt
gctacttgatccatcagcttccatgtcagattctgtgcttcatctttaaccttgtctctc
attctgtctactgacgctgagacaataattgtgatttaggacttcccattgtgctgataa
gctgtccacaaaggcatttacaatttctaatccaatttatgacacctggtagttgctcag
atgttacttcaggtccagggtcacactgggggttgctgatgtagcacggtaattcttgact
gcctggcagctggccacccatgttgtgctgtttcactccatgcagtagaccactgtggga
gtctgccccactcagtctcaccaggaatagcagaggtggtaggaacagtgccaggtgctg
agtacctccaaaactagtttaaaaaagaaaatcctcgtcttaaatttgttactcactttc
ctctggattacttttcttaatatgtcccaaacaaactgggt >IGR3273a
tgttgtgctgtttcactccatgcagtagaccactgtgggagtctgccccactcagtctca
ccaggaatagcagaggtggtaggaacagtgccaggtgctgagtacctccaaaactagttt
aaaaaagaaaatcctcgtcttaaatttgttactcactttcctctggattacttttcttaat
atgtcccaaacaaactgggtccaggccagggcccgcctcaagcagtgttcccttgctgc
tgtctgagtgtccatgaagggctggtgcttttcctcagtgatcatatgcagttcacccat
cttgttttgtttgggaaaccacatttgtgccgcagccttacttcttggacagaactgtaga
cttgtttgtgatgtttgctctgcctgtgctgccagggcatggttgtcttccaccttagag
aggctgctcttgggagttctggttgttttcaggcctgggaagatggtatccctagagtga
ttggctgctacagagctgttcatgctgcttacaaggtctaatgctgttatttcccacagg
ttgcaaattatggagtgggaggacagtatgaaccgcacttcgacttctctagggtaaggc
ctaaatcacaggtgctttcaaagggccctgctctagctgatttgagaaggggtggagcttc
taggagcatttcagcctccacatcagtaccccacccctt >IGR3274a
catgctgcttacaaggtctaatgctgttatttcccacaggttgcaaattatggagtggga
ggacagtatgaaccgcacttcgacttctctagggtaaggcctaaatcacaggtgctttca
aagggccctgctctagctgatttgagaaggggtggagcttctaggagcatttcagcctcca
catcagtaccccacccttgtcctccctccacctctgcatcaccaggggaaactcttcg
ttactggtgaatcccaaatctggaaccaagggtcctgcagaatgcagtggagcctggctg
tctcccctgtagatgtgggggcttcgtcccctgccctaattctgtcaccctttgccctga
ttctaaagcaaagagcctcactaggtcttttgtgaaaactgttcttgtccctttttcctctt
ccccgtctactccatgccctagccagaatttactttgcagctttggcacatattccaggc
tgatttatggaacacacacttattacttttccctgaccctttttggtcctagtcttgtggg
tggtggatgaagcctgttgtaaacttgggtgaaagttgttgtctgttgcagcgacctttt
gacagcggcctcaaaacagaggggaataggttagcgacgtttcttaactacgtaagtact
gggtccaggcccacctgttcattctcacttaattttgtag >IGR3275a
tattacttttccctgaccctttttggtcctagtcttgtgggtggtggatgaagcctgttgt
aaacttgggtgaaagttgttgtctgttgcagcgaccttttgacagcggcctcaaaacag
ggggaataggttagcgacgtttcttaactacgtaagtactgggtccaggcccacctgttc
attctcacttaattttgtagaatgatgagcgagatacttcaagcatttagggacgggga
atcgtgtggctactttcttaaactacgtgagtatgatgtgtgctgatgagccctaagggg
accctgggtccagagggctgccttatatcccaccccatcagggctgatctcatctgctg
ttaagtaatggtcaggtccttctggctctcagcacccttcttggctgcagtagggagagt
tggcctctgtttctattcattttcccactgccaccagcaggactttaacattcctggct
cctatttttttcccagtgtttaaaattgtgataaaacagacataacataaaaacttacca TABLE 5-continued tcttaaccatttttaaatgtaccggttcagtggtattaaatacattcatagtgcgcaagc
atcaccaccattcatttccatctattttcatcatctaaaactgaaactctacccattaag
caataattccagattccctcctgcagctcctggcagcca >IGR3276a
ttaaaattgtgataaaacagacataacataaaacttaccatcttaaccatttttaaatg
tacggtttcagtggtattaaatacattcatagtgcgcaagcatcaccaccattcatttcca
tctattttcatcatctaaaactgaaactctacccattaagcaataattccagattccct
cctgcagctcctggcagccaccattctgtttctgtcgctntgattttggttacttaaat
aaatggaatcaaagtattaacacttgtcttttgtgtggctggtgcataatgtcctcaag
gtttatccatgttgtagcatattctggcttcttcttcttcttttttttttttttttttt
tttggagatggagtcttgctctgtcacccagactggagtgcagtggtgggatctcggctc
actgcaacctcagcctcccaggttcgagtgattctcatacctcagccttccaagcagctg
ggattataggcgctagccacaacgcctggctaatttttgtattttagtagagatagggt
ttcaccatgttggccaggctggtctcaaactcccgacctcaggtgatccgccccctcgg
cctcccaaagtgctgggattacaggcgtgagccactgcgccctgccattctggttccttt
ttgatgggcccagtgctagtctggacttttgggatgggtg >IGR3277a
aacgcctggctaattttttgtattttagtagagatagggtttcaccatgttggccaggct
ggtctcaaactcccgacctcaggtgatccgccccctcggcctcccaaagtgctgggatt
acaggcgtgagccactgcgccctgccattctggttccttttgatgggcccagtgctagt
ctggacttttgggatgggtgccctggagggttccctccttggcatcagagtgaggagata
gccttagctctctctagatgagagctgcctttgtgttctccaaggcttaatggcctgatt
cccacctcttgcctctgtttttatccataggttgtagggtttatctttcacatgaggagca
gtttcctctccctctgctgagagccagtctctaaagaggcatagaggcagtaaagtaact
tggagacagaagcctgtgtccattttttccctttatgcttttattgtgtggttattacat
gctggggattgtgctgtgtacatgctggtgagcagaacatatgtggtctcncttgtgctt
gaggtccaatatgagagactttattttaaacatcagagagattcttctttatcttttttt
ttttttttttgagacagactctccctctgttgcccaggctggagtgcagtggcgctatc
tcagcttactgcaaactctgcctcccaggttcaagcgatt >IGR3278a
catgctggtgagcagaacatatgtggtctcncttgtgcttgaggtccaatatgagagact
tattttaaacatcagagagattcttctttatcttttttttttttttttttgagacagac
tctccctctgttgcccaggctggagtgcagtggcgctatctcagcttactgcaaactctg
cctcccaggttcaagcgattcctgcctcagcctcccaagtagctgggattataggcgt
gcaccaccatgcccagctaattttgtattttagtagagatgaggtttcaccatcttgg
ccagactggtctcaagctcctgacctcaagtgatccaccgccttggcctcccaaagtgc
tggcattacaggcgtgagccaccatgcccagcctaaacatcagagagattattatgtagt
tatggagacaggtgctgtgaacccaggctttgggggttcagtggagcctctctttggaag
taacatatcagttgagacttaaaagttgagtggaaattagctggtagaacatggtttctg
gcagaagagagagtgtatgtagtcctgtaagagaaaaggaacttgggatgttggaaaggt
agaaaaggctggtgtgtctggagagaggctagtgagactgacagggccttgggggttcta
gaaaagaatctgagtttgatccacagggctgtgagaagcc >IGR3279a
aaaagttgagtggaaattagctggtagaacatggtttctggcagaagagagagtgtatgt
agtcctgtaagagaaaaggaacttgggatgttggaaaggtagaaaaggctggtgtgtct
ggagagaggctagtgagactgacagggccttgggggttctagaaaagaatctgagtttgat
ccacagggctgtgagaagccatcagagcttttgtcttattcatttaccatatgtctgtca
agtacccttcagtgagtctggtatgtgtcctgtgaaatattttttacctccaatttttta
ttaaaattatggacaaaaaaagtaagagagccagatgggaaagaagtagtgctttggccat
gagtcaaggcatgctctgtgggcatgagtacagccttgctagtgtggaacttgtgttcaa
tgtagtttaaggccttaccataggagaaagcagggcctctagagacacagtgccccaccc
ttccactcagttggccccaggaagggtggctactctgggaaggtgaaggtctgactagag
cagcaaactactagagccagagaaacagagctgcagtggggactgcacatggtgttggaa
acagtacagagctcctggtcagggcactttgcagagtacagtggcttaggcaaggccaag
gctagatgggattcaaagggtggggtcagaacaggcatt >IGR3280a
gaagggtggctactctgggaaggtgaaggtctgactagagcagcaaactactagagccag
agaaacagagctgcagtggggactgcacatggtgttggaaacagtacagagctcctggtc
agggcactttgcagagtacagtggcttaggcaaggccaaggctagatgggattcaaagg
gtggggtcagaacaggcattttctgagtacagactcagattattttcatccaggacagc
ccggatgtgggtctcctgtgggcctcaactcttgaacactcatgacatggagactgttct
aatgaatcacactggttaagtaggcatgggaagagcctttcttggctaaagggctggcca
tggagcagacaccaagtagtgtcactcatgctgagaggagggcaatctatataccttgtc
atgtcctttgtggctcaattgctctgagagccttgggtaggagggtcaagctctatgtct
tatatttccagatgagtgatgtagaagctggtggtgccaccgtcttccctgatctgggg
ctgcaatttggcctaagaaggtaagttctgattcttgtgggtcagaggttgaagcaaggc
tcagactttactttgtccatgtcccccagtaccattacctggcctgcctgattgtcactg
tgatgtgccttagcccacctggggtctgacctggtagccc >IGR3281a
gtagaagctggtggtgccaccgtcttccctgatctggggctgcaatttggcctaagaag
gtaagttctgattcttgtgggtcagaggttgaagcaaggctcagactttactttgtccat
gtcccccagtaccattacctggcctgcctgattgtcactgtgatgtgccttagcccacct
ggggtctgacctggtagcccagcttctcctgtgaagaaaggacagggagggaagtccct TABLE 5-continued tcagggtgggtgagttcccagacttctacctcagaaaggtaggtgctttctgggaaatg
tctctgttgctggagtcccagagccctatccctgtccatgggaaaatgagggtgtttct
gctcagggcagagcttctgtgatgcttgcagtcaggtccctgagcacagtctcttaagaa
tgtgttctgaaaggccatctctttcccagggtacagctggttctggtacaacctcttgc
ggagcggggaaggtgactaccgaacaagacatgctgcctgccctgtgcttgtgggctgca
agtggggtgagtgtcttaaggggtagtgttggtgttggtggcctcagcttgggctttgct
tattggccttagattctgagctggggaggcaactgctgccaaatttgctgagactgtctcc
cttcttaggttttttttctgctgttattaccatccagccat >IGR3282a
cgaacaagacatgctgcctgccctgtgcttgtgggctgcaagtggggtgagtgtcttaag
gggatgtgttggtgttggtggcctcagcttgggctttgcttattggccttagattctgag
ctgggaggcaactgctgccaaatttgctgagactgtctcccttcttaggttttttttctgc
tgttattaccatccagccatgtaatgtccatgcagctggtaaatgccaaggcagctggtt
ggaaacactcagagatacacaggaagctgaagaaggcctgaggacgaatagctcataag
caccataggtccaggaccctctggcaaggcttctgagggagcagagtggagagctggaag
cagtgagggggaaagagtgtctcaggcaaacaaggcccatatggatggaggcacaggctaa
aaccagcatacgggtgtgggggctggctcccttgtcacttgaagaaagggaggcctgtgg
cacaggggccagaagatgaggctggaggctgggaccaaactgcagaggctcaagcttgag
ccttatcctgggagcagttgtggtgagcctcggagaggctcaaaccaggatatgacagga
agtgtttgtaaggagatgagtgtgtagccccccttggagagttttgaagataaatagtgat
aggtttgcagataattaagcaaatggaaaagaaaacaagg >IGR3283a
gctggaggctgggaccaaactgcagaggctcaagcttgagccttatcctgggagcagttg
tggtgagcctcggagaggctcaaaccaggatatgacaggaagtgtttgtaaggagatgag
tgtgtagccccccttggagagttttgaagataaatagtgataggtttgcagataattaagc
aaatggaaaagaaaacaaggcagttgctgaattcaggggaaaaaaagttgtacaagaaag
gaaatgtaagtataatctactagatggctcaggtgtaacacatgatataattatgtacac
actgagtattactttaactaaaacttatgatttacctgtactggaaaggtgggagggat
gagtttgtgtttaggggtagaataaaagaattccaaagttgaaagtcaaggaatagaac
tataagcatcttatctagaaaaatgaggttaaatatcagaagaaacagctagaggagttt
aatgttccctgggagtggagattagggatgggaaggagaggcttaggaggagtgctattt
atcattataagccttgcgacaattttatttttttcaatgaagtacatgttattactttat
attttaaaagctctgtgacttcagtagtgcattgaaataaaattttattcattatgaga
gagtctgtgaggaacagaatcatggttcctgtgtgtttga >IG3284a
attagggatgggaaggagaggcttaggaggagtgctatttatcattataagccttgcgac
aattttatttttttcaatgaagtacatgttattactttatattttaaaagctctgtgact
tcagtagtgcattgaaataaaattttattcattatgagagagtctgtgaggaacagaat
catgttcctgtgtgtttgaagatatggcgtggggtgatagtgctggcagcagctctgtt
gctcttgtgcccatggcatacagactggatctgctggtccacggctcctgaggtaatgt
ccaagccctctgcaatgctgacagtcttcctcatcctcacaccctacctctcagtttcta
cctgccacctcccagtaatattaggcctcttgagtccccaacacacgtcagggtggcttc
tgccttgattacttttctcatcctgttgtcactcctgggacccctcttggtgagagaaccat
ctgggtatgcccatcttcttcccaggataacttctatgtagctttatattctagccctag
gatttcctcttccctctaagagcaagaaacatgtgtgcaggttgccatgggaatagagcc
aaagggcatcaaaggtcatgggcatgaaagggcatgattagatgcccttgggtgctattc
ccatggcaacctgcacacatgtatcttgtcccactggcag >IGR3285a
cccaggataacttctatgtagctttatattctagccctaggatttcctcttccctctaag
agcaagaaacatgtgtgcaggttgccatgggaatagagccaaagggcatcaaaggtcatg
ggcatgaaagggcatgattagatgcccttgggtgctattcccatggcaacctgcacacat
gtatcttgtcccactggcagaatttcatacaattatctgtttacatgtgtcttccttacc
aattcttcagcaaattgaggcctgagatcatgtcttgtctttattgtgtctgattccagg
gcacagtgcaggggtcatcatgaaggagtcattcattcaggctactaaactgaccaata
ggattgtaaacatgcttgctttcttttcacagtctccaataagtggttccatgaacagagg
acaggagttcttgagaccttgtggatcaacagaagttgactgacatccttttctgtcctt
cccttcctggtccttcagcccatgtcaacgtgacagacacctttgtatgttcctttgta
tgttcctatcaggctgattttggagaaatgaatgtttgtctggagcagagggagaccat
actagggcgactcctgtgtgactgaagtcccagcccttccattcagcctgtgccatccct
ggccccaaggctaggatcaaagtggctgcagcagagttagc >IGR3286a
catgtcaacgtgacagacacctttgtatgttcctttgtatgttcctatcaggctgatttt
tggagaaatgaatgtttgtctggagcagagggagaccatactagggcgactcctgtgtga
ctgaagtcccagcccttccattcagcctgtgccatccctggccccaaggctaggatcaaa
gtggctgcagcagagttagctgtctagcgcctagcaaggtgcctttgtacctcaggtgtt
ttaggtgtgagatgtttcagtgaaccaaagttctgataccttgtttacatgtttgttttt
atggcatttctatctattgtgcctttaccaaaaaataaaatgtccctaccagaagcctta
aagagccttacttggagtattttaagactggaagcttttaccaggttcatcatttccta
tgcatcaccttcatgcaggcagagtctggataatgaatgctttagcagcaaaaaagcatc
ttgggtcttggatttcagacctgtttcaacacttgtgttccctctaagtgtcagtgtcc
ttttctggaaagtaggg taaatagtttctctttgtctcccagagaacatagcacatgtcc
tcatgattgtaatgctgttataatgtgtacttcatttttaaattttgagataagaattgt
tcatgatacacagatgtatacttaaaaaaatatgaaggtg TABLE 5-continued >IGR3287a
ctggtttcaacacttgtgttccctctaagtgtcagtgtccttttctggaaagtagggtaa
atagtttctctttgtctcccagagaacatagcacatgtgttcatgattgtaatgctgtta
taatgtgtacttcattttaaattttgagataagaattgttcatgatacacagatgtata
cttaaaaaatatgaaggtgagcaggagcacctgtgtcaacaccaagttagaaaagagaa
cgttttcaagtcagtacctcaggagccccttgggaaccccctcctagatcacatctccttc
actgcccccagcactttggagataaatcattgtctcatgatgtgtggtactcattccttt
gcttgtctttatagttttaccatctatgattagatccctaaataagtagttattctgttt
tccctgattttgaacttttactaatagaatnagagtaaatattttgggtatgtggcttc
tttgttcaacattgttttaagattcatccgtgttgcttgtgtagctgtaatttgtttta
atctttatagtacattcagttttgttaatgcttattgtaggactgtaccataatacaggc
agcatgctgctgataaacactggaattgatttcagtctttgtatattgtgaataatgctg
tgataaacatttttatacatgattcctggtgcacatataa >IGR3288a
agattcatccgtgttgcttgtgtagctgtaatttgttttaatctttatagtacattcagt
tttgttaatgcttattgtaggactgtaccataatacaggcagcatgctgctgataaacac
tggaattgatttcagtctttgtatattgtgaataatgctgtgataaacatttttatacat
gccggtgcacatataaacacatatttctgtaggatatatatctaggagtggaaatg
tggagtcttaatggtgttccaacttttactaaataatgtattccaaggtggttatacacat
tctcaccaggagtaaatgagagttattacccccaatcttttccantatttagtattttcat
acttttgaattttagctagcttggtacatgttacggactaaatgtttgtgtcccccccacc
agattcatatgttgaaatctttttttttttttttttttgngacggagtctcgctctgt
cgcccaggctggagtgcagtggcgngatctcggctcactgcaagctccgcctcccggntt
cacgccattctcctgcctcagcctcccaagtagctgggactacaggcgcccgccactacg
cccggctaattttttgtatttttagtagagacgggggtttcaccgttttagccnggatggt
ctcgatctcctgacctcgtgatccgcccgcctcggcctcc >IGR3289a
ggcgngatctcggctcactgcaagctccgcctcccggnttcacgccattctcctgcctca
gcctcccaagtagctgggactacaggcgcccgccactacgcccggctaattttttgtatt
tttagtagagacgggggtttcaccgttttagccnggatggtctcgatctcctgacctcgtg
atccggcccgcctcggcctcccaaagtgctgggattacaggcgtgagccaccgcgcccgg
cccatatgttgaaatcttaaccccaatgtgatgatattaggatgcggagccctgggag
gtcgtaagcatggagcccacgtgagtgggattagtgcccttatgaagagatcccagcccct
ctttctgccatgcgaacacacagcaagaagatgcctgtctatgaaccaggggcccttac
cagaaacaaancctactagcatcttgatctcggactttccagttcccataaccatgagaaa
taaatgttttttaattcaatgtatggtatttttattatagcagctctacctaagacagtaca
tgtatagtgtctatttgaacattactgataatgttgaacaacttttcatgtttattagtt
attaggtttcttcaagtgttcttattcatacaaattttaaaatatgtacacaagttcttt
gttatatattttgcaaatatcttctgtggcttgtcttttca >IGR3290a
atggtatttttattatagcagctctacctaagacagtacatgtatagtgtctatttgaaca
ttactgataatgttgaacaacttttcatgtttattagttattaggtttcttcaagtgttc
ttattattcatacaaattttaaaatatgtacacaagttctttgttatatattttgcaaat
atcttctgtggcttgtcttttcactattttagttctgtcttttgataaacaggagcttt
aattttttatgtcaaatctatcaagcttttcttttttgatttatgtttttttatgtcttatt
tgagaaatccttctataccccaagatcatgaggatgtttcctgtgttctcttctgaaagc
tatatagtctttgtcatttaggtttatctttatacgtggtatgaagtgtaaagttctact
tttaattttttgcatattttattaggataggatgggctttttctgtagtaataatccnta
aatctcaggggcttaatatataaaattgtctcatgcaaaaaaccactgggtctagggcaa
ttgctatctactgccgtctaatctccctcagtggcttccattggtagaccctaacaggaa
agccagctgataagggaatctgggaaatgtagtttacagagtggcagctacagtagaaca
gtagagactacaaggatgagcttgcagctgagaatagaaacgt >IGR3291a
aattgtctcatgcaaaaaaccactgggtctagggcaattgctatctactgccgtctaatc
tccctcagtggcttccattggtagaccctaacaggaagccagctgataagggaatctgg
gaaatgtagtttacagagtggcagctacagtagaacagtagagactacaaggatgagctt
gcagctgagaatagaaacgtgactggcacactaggtggtttgtttgtaggttttttcttt
tcctgtttgagacttttttggattcttgaatttgtacaatgntntccttaatcaattgtg
gaaaattaaatgatttttttctttcagcattgtctgtttcttctgtaactgattaaatgta
agttggatcatatcatgatattatctcttaatctgtctttcatatttttatatatatgct
atatttggggagaactttatagctgttttgtacaaagttcactaattctgtcttctatca
agtgcatacaggagtctgtttaaggactttaaagatgtaattctttgttttctggcttat
accatttctgttgaaaagtcgctatctggtcctttgttgttcctttgaaggtgattttgc
cttcacctggctgctttaaagattttttctttttggttttcagtagttttactatggtg
tacttagtatgggtttcttttctttttcttgcttggcatt >IGR3292a
taaggactttaaagatgtaattctttgttttctggcttataccatttctgttgaaaagtc
gctatctggtcctttgttgttcctttgaaggtgattttgccttcacctggctgctttaaa
gattttttctttttggttttcagtagttttactatggtgtacttagtatgggtttcttt
ttcttttcttgcttggcatttagcttcttgaatttctgggttgatgtctgatcaatttg
gaaatttctcagacattatatcttcaactattgtttctgtcccatttttttctctatctgc
tctgagacttcagtaatctgaatgttagaacttttcatagtgctctatatatctccagtt
cttgtgtctctcatgctttttctttgtgtttcagactagatattttatactgatctgtc
ttgcaattcattttattacttttgctgctaaacccatctactgagttcttaatttcatttt TABLE 5-continued tcttatatttctcagttctaaaatatccattcatgtcttttttttttttttttnccttg
agacggagtctttctctgtcacccaggctcgagtgcagtggcgggatctcagctcactgc
accctctgtctcccagattaaagcaattttcccacctcagcctcccaagtagttgggatt
agaggcacgcaccaccacacccagctaattttgtatttt >IGR3293a
aaatatccattcatgtcttttttttttttttttttnccttgagacggagtctttctctgtc
acccaggctcgagtgcagtggcgggatctcagctcactgcaccctctgtctcccagatta
aagcaattttcccacctcagcctcccaagtagttgggattagaggcacgcaccaccacac
ccagctaattttgtattttagtagagatggggttttgtcatgttggccaggctggtcg
caaactcctgacctcaagtgatccacctgcctcagcctcccaaaatgttgggattacagg
cgtgagccaccacggttggcccattcatgtccttttaatggattttaactctctggagaa
tctgtcttctgtttctctgtgttttctcggactgataaatcagttatgtgaatttttt
tgtccgataacgccatgatttcgattttctatggctctctttctattgtcttttccctc
cttagtttctggtcatttggtccactctgttgatatgcctggcaatttttgattgaatgt
gtatgacaaattgtagagcctctggatggataacctcctgcacaaagggctcacccttc
ctctactatgcagagtggggatcaatcaccttaatccagtaaggatctgagctgacttaa
aattaagactgggtggtagttttcttaagactctatctct >IGR3294a
tccactctgttgatatgcctggcaatttttgattgaatgtgtatgacaaattgtagagcc
tctggatggataacctcctgcacaaagggctcacccttcctctactatgcagagtgggg
atcaatcaccttaatccagtaaggatctgagctgacttaaaattaagactgggtggtagt
tttcttaagactctatctctggtttacccttatttccccccttataggatgtagtcctcc
aggattttctaattgagagcctagtgtgttcactggatctgttttccactggcagttcctc
aactctaattcttgtcttctcagtaccagactcagcccaaaaaatttatcctcctttttca
aagaatttgaattttttgaatctaagcagatattttttgcttaccttcttagccttgcatt
ctgcacagcgtcagaattcagaaaatgcctcagtgggtaaacaggctgagtggccaagtt
ctccactcctccctcttattcaatattctgagaaactactggctaattttggtttttcaa
tgcccccttgacactgtcaannnnnnnnnnnnnnnnnnnnnnnnnntnnnanntnnncattg
ctctggatcctcattcttaccccatggctacaatcagtaaataataataataataataat
nattattattattattatnattattattattttgaggtgg >IGR3295a
caatattctgagaaactactggctaattttggttttcaatgcccccttgacactgtcaan
nnnnnnnnnnnnnnnnnnnnnnnntnnnanntnnncattgctctggatcctcattcttac
cccatggctacaatcagtaaataataataataataatnattattattattattattatnat
tattattattttgaggtggagtctggctctgtcacccacggttggagtacagtggtgcaa
tctcggctcactgcaagctccgcctcccgggttcacgccattctcctgcctcagcctccc
gagtagccgggactacaggtgccaccaccacgcccggctaattttttgtattttttagt
agagatgggggttcactgtgttaggatggtctcaatctcctgacctcgtgatctgtccgc
ctcggcctcccaaagtgctgggattataggcatgagccaccacgcccggccagtaaattg
tttaaggataaaagagactacagacttttggctcacccacaagatttatccttcttcagg
atcttgatgctcaaactcttttttgcttcagcaattgactgatgtcttccaacaattttaa
gagatttattcagctttattctaggaatgaaaattggtctaccataagctactctatct
tggaagtagaagtggcctattcatttttaaaaaatcatt >IGR3296a
cagactttggctcacccacaagatttatccttcttcaggatcttgatgctcaaactctt
tttgcttcagcaattgactgatgtcttccaacaattttaagagatttattcagctttat
tctaggaatgaaaattggtctaccataagctactctatcttggaagtagaagtggcctat
tcattttttaaaaaatcattttttcctatactgatacagaaaccttatctttcatatctt
cttttgttacctagtataacaagacgcttcacactcatcttgagcatttctgacattaag
catggaatcagccgttaaaagaatcttattatatgttgatgtctgcctatcaatcccagc
atggtcctgggaacaagcatgagataacttctgtcttagagccagggcactgcttcagc
aatcctattaattgagcttggcattaatatgttcactagggcagtaaagagttattgag
cgtttcattatgcatttggtactgtgctagggatgttacagtctattactgcattcagca
actcttcagaacgaatacataaagaagcagaacgtcagaaaggttaggtaatataccga
ggtcacatgaagtctcattgctggtaagtggaggacctgggaatgaaactctggcagctt
ccaaaagccttgctctaaaacaaaatttatattttcatgca >IGR3297a
ctgtgctagggatgttacagtctattactgcattcagcaactcttcagaacgaatacata
agaagcagaacgtcagaaaggttaggtaatataccgtgaggtcacatgaagtctcattgct
ggtaagtggaggacctgggaatgaaactntggcagcttccaaaagccttgctctaaaac
aaaatttatattttcatgcatttaacagttattaaagatttgatggggaaacataaagac
tgtctttatctttaaagaattctgagcaatgaagggactcataaataggtgtgtaaatg
gtggggaagtctggtaacagagaatgtgcttgaggagcacagtagagtgaaggtctactt
aaccaagaagttggcactacagtaggcaccgttggagctgggtcttgaagtatgagcagg
aatttgtttactgtgctatcctagtttaaaatacatgcacgtggcttaaaaaataaggga
caaaggaaattaccctaaatagttgctgtccacccttactgccaactcctagtcccctt
cctgaggaaccttttcaaattatttttaaattttttctgcctattaaatgcttataaaatg
ctgttccttgatttttccacttcagaaatttgagagatgatcatttagtttatattcact
atctcccatggtacctcccctgcctttgccattttttga >IGR3298a
agttgctgtcccacttactgccaactcctagtccccttcctgaggaacctttttcaaa
ttattttaaattttttctgcctattaaatgcttataaaatgctgttccttgatttttccac
ttcagaaatttgagagatgatcatttagtttatattcactatctcccatggtacctcccc TABLE 5-continued ctgcctttgccattttttgatagttatattttgtatagtcctctcttgtttgcctggcaa
cataaattttttgtttggttaaaactaagatggtgagatgaagatctaaactagaatt
taccaaacaaatgatcactattgtctagccaagttgacacatagaattaagtatcatata
cccttttgtctcccaactgccggtcagttatgctttggacattattttagtagccatagt
aagttgcttctaaaagtgaaaaacacaaatgttatgtttcttaatttcgttgaattagtc
actataatgttgatgtagctaatcataaaaggaatttgtgtcttatttgtctaatagaa
ttcaaaatgaatttataatgtatataatttgatagggctacaataacaaaataccacaca
ctgggtggatcaaacaaaggaatttgttttcttactgttccagaggctagaagtctagg
atcaaggtgtcaacaggttgtgtttcttctgaggcctcac >IGR3299a
aatcataaaaaggaatttgtgtcttatttgtctaatagaattcaaaatgaatttataatg
tatataatttgatagggctacaataacaaaataccacacactgggtggatcaaacaaaag
gaatttgttttcttactgttccagaggctagaagtctaggatcaaggtgtcaacaggttg
tgtttcttctgaggcctcactgcctggcttggtctgtgtgttgtctatgtcacctcttgg
tctatgtgttgtctatgtcatatcggattaaagcctgcacatatgaactcattttactttt
aattatgtctttaatgccctgttgccaaatacagtcacatattgggttaggactttagca
tatgaagttttgggagaacacataaaactactaggaaatcatgttagatctgatatacta
ttgagactaaagcaaaatacttttccttactctttgtacatcagatatagcccatcatga
acaaatgtatctgattattaagtatgtttgcataagaataatgtcataacactagaagtt
ttttattttgagaaaagagatataggctcttatgaaattattaataaattgaaaaaagat
attgacataaaatatcttgaggccatggatataattggacaaatacagcaggtgtgtata
taagggtggaaaagccattattttcccccaaaatggttat >IGR3300a
gtatgtttgcataagaataatgtcataacactagaagttttttattttgagaaaagagat
ataggctcttatgaaattattaataaattgaaaaaagatattgacataaaatatctttga
ggccatgatataattggacaaatacagcaggtgtgtatataagggtggaaaagccatta
ttttcccccaaaatggttatgccaaataagttcataatctgtgcaaaaatgctgcttcta
tgaattaaaaataacctttttagtgtgtacaaatgatacataatctttttatgaattcat
tgagcagtggaatgttatgcttgttctaaaaactacattaaaaacaaatcctgagaggca
tcaaagtcaaatatgatcaaggtacttttacacaaagatgtttgtcaaatattaaaagaac
ataaaatgacaaaatacaatatcctgaaataggaaccatctttgtgtgaacagattacaa
attttcatgtaacttgtctatgtggcatggcattttgaactaatatagtagaaaaaggt
ttatgaaaaaaagactatatacaaagctgcatgcttaagaaaaggcctattcgtttgcttgct
tataacaaatgagngnaagtaacttaangttatgtttcgttaatgtaanactttaaangn
gntataantntacttnangnnaaatcagaaatatacaaat >IGR3301a
tgtggcatggcattttgaactaaatatagtagaaaaaggtttatgaaaaaaaagactata
tacaaagctgcatgcttaagaaaaggcctattcgtttgcttataacaatgagngnaagt
aacttaangttatgtttcgttaatgtaaaactttaaangngntataantntacttnangn
naaatcagaaatatacaaattactgaatgagtatatcaattattgtgggaaaagtgttcg
tcgaatagaaattaaagagattacagatgtcctagagatggagatatgaaaaatcaaatg
aagtttttgtatttttacttggagaaattttctacgaatacatctgattaacaaaaag
cagccatggccttgacttacctcttaaatagtccaatgatttatatcctgtggcaatttc
atctgaaatagtggtaaatagcatgcaatatcaatagtttgcatgaacaaatgtgaccct
gaaagagccagtccttcaagatggatcttaagtggctgagtgggcctaaatttaaagcag
agccaagaagccatttggtgactagaggccacacacctattttgagttccctgaaaaccc
acacctctttaactttggaactttcagagctcacctgaaccagccaatcagagcccacct
cccttgctgctcagttgtatcaaccaatcagaactgtgtt >IGR3302a
atggatcttaagtggctgagtgggcctaaatttaaagcagagccaagaagccatttggtg
actagaggccacacacctattttgagttccctgaaaacccacacctgtttaactttggaa
ctttcagagctcacctgaaccagccaatcagagcccacctcccttgctgctcagttgtat
caaccaatcagaactgtgtttccatctcatttgtatcagtgcacctgattgggaaccagg
gcaggaacttttttgctataaagctagaacccttcctttgttcttggaccgcaccttcct
tttacattgaaggctgtgttggactccctagtttgcaaaactattcactggaataaaagtc
tctttcttccagggaacttttgttcacatttgtaatataaaatcatgatgtttgtatcct
ctaaaacggatttgcaaattttcttcgggcagccttacccaaatttcaaatggtcctg
ataattttttaaaacaataccagtcacagtgtgatatagtttggatctgtgtccccacc
aaatctcatgtcaaattgtaatcttcagtgttggtcatgggcctggtagtcggtgattag
atcatataatggaggcggtccttcatgaatggtttagcaccattcccttggtgctgttct
cttgatagtgagttattgtgagatccggttgtttaaaagtgt >IGR3303a
agtcacagtgtgatatagtttggatctgtgtccccaccaaatctcatgtcaaattgtaat
cttcagtgttggtcatgggcctggtagtcggtgattagatycataatggaggcggtcct
tcatgaatggtttagcaccattcccttggtgctgttctcttgatagtgagttattgtgag
atccggttgtttaaaagtgtatacacttgggaggctgaggcgggcggattgctttga
gctcaggagttcaagaccagcctaggcaatatggtgaaacctcatccctacaaaaactac
aaaaaattaactgggcatagtggctcactcctgtagtcccagctactcaggaggctgaggt
tggagaattgcctgagcccgggaagtggaggctgcagtgagccaagactgtgtcactgca
caccagcctgggtgacagagacctgtctcaaaaagaaaatgtagcacctccctctctctct
ctctctctgtctctctcactgtctcgttctcttgctcttgctccttctccagccatgtaa
gatgtgcttgcttcccctttgcctttagccatgattcatagtttcctgaggcctctccag
aaaatggaagccactacacttnctgtacagcctgtagaaccatgagccaataaacctctt
tctttataaaattacccattttcaggtatttctttatggca TABLE 5-continued >IGR3304a
gtctcgttctcttgctcttgctccttctccagccatgtaagatgtgcttgcttccccttt
gcctttagccatgattcatagtttcctgaggcctctccagaaatggaagccactacactt
nctgtacagcctgtagaaccatgagccaataaacctcttttcttataaattacccatt
tcaggtatttctttatggcaatgcaagaacagaccaatgcaccatggtatcctgcaaaat
cctgaagttaattaagaattatttaagaggcgcggtggctcacgcctgtaatcccagcac
tttgggagggtgaggtgggnggatcaggaggtcaggagattgagaccatcctggctaacg
cggtgaaaccccgtctctactgaaaatacaaaaaattagccgggcgtagtggcgggcgcc
tgtagtcccagctgcttgggaggctgaggcaggagaatggcgtgaacccgggaggtggag
cttgcagtgagccgagattgcgccactgcactccagcctgggcgacagagcgagactccg
tctaaaaaaagaacattatttaagatcgtcacttaagaagagtagattttgacaatttt
attgatcagtttacttccattaaagtcattggtataaaatatttaaacttaatatgagtt
ttaatataccaactttcaatattgtcaaccaatttaatgt >IGR3305a
cgccactgcactccagcctgggcgacagagcgagactccgtctaaaaaaagaacattat
ttaagatcgtcacttaagaagagtagattttgacaattttattgatcagtttacttccat
taaagtcattggtataaaatatttaaacttaatatgagttttaatataccaactttcaat
attgtcaaccaatttaatgtgtaaaaattaacaaaaacgaaaacgtacgtaagaagca
tacgttttcattttgcctcaggcttcaatatagtttggcacagcactgctcttcaagtt
ccaaacttggcattttgnctccaatattagatttgccagattcagcaaatgaaaatacaa
gtaacacccagtttaacttagataaataacacataattttttgcataggatatatgcata
ctaaaaagtttgttgcttatctgaaatttaactgggcattttgtataatatctggtaatt
ctaaaaataattatcttacatggttgaaaaagctgcctgcttcttagtacaatgtaactg
ttgcaccaacaccgtcttgcctgtttgattgctggttatgtggatgactgaagcgcanac
angggagtcatatggnttntgtgtcacantgtccagcntgtaggtatgtccagtcctta
ccaggtntagaagaacacagcagcctcactccatccgagg >IGR3306a
tggttgaaaaagctgcctgcttcttagtacaatgtaactgttgcaccaacaccgtcttgc
ctgtttgattgctggttatgtggatgactgaagcgcanacanggggaagtcatatggnttn
tgtgtcacantgtccagcntgtaggtatgtccagtccttaccaggtntagaagaacacag
cagcctcactccatccgagggcagaggagcgagcatattccccantgccatgaccctctc
cccagctccntctgnttcagtcacactgacggccccagtacattcgtgnttgttggtcct
tctgcctggaaggtaccaatacctagtagtttntaccctcattccttcaagactgatca
aagattaccttatccaaagagttcttcttgtttcactgctgtgctgctcggggctagtct
ggaattcctggcctcaagcaatcttcccaagaggttcctcccttcctccctccctccctc
cctcccttccttcccttttcttcgacagtcttgctttgttgcccaggctggagtgcaggg
gcgcagtctcggctcactgcagcccactccaagaggccttcatgactactacgaaggatt
tgcgttctcattctcttcctccttagcctgttttctttcttttttcttttcttttcttt
tttttttcttttgagatggagtcttgctttgtagcccag >IGR3307a
ttcgacagtcttgctttgttgcccaggctggagtgcaggggcgcagtctcggctcactgc
agcccactccaagaggccttcatgactactacgaaggatttgcgttctcattctcttcct
ccttagcctgttttctttcttttttctttttcttttttttttcttttgagatgg
agtcttgctttgtagcccaggctggagtgcaatggtgcgatctctgctcactgcaacctt
cgtcccctgggttcaagcgattctcctgccttagcctcccgagtagcttggattacaggt
atgcaccaccacgcccgactaattttttgtattttagtagagacagcgttccaccatgtt
ggccaggctgctttccgatccctgacctcaagttatcctcccgcctctgcctcccaaagt
gctgggattacaggcgtgagctaccacgcccagccctgttttattttttcttagagcact
tatcactgaggtaaaagtgggacttgactccagacgcaggcgtcggacaccggaccaga
ttgaggactggctaaaacagggccagggccaaagtagctttcaatcagcccaccagggtg
ctacgtcggttttgcagttgctatgacaacaccctggcgttagggccccttccatggtaa
tgacccaatgaccccaaagttactactccttctctggaag >IGR3308a
ggacttgactccagacgcaggcgtcggacaccggaccagattgaggactggctaaaacag
ggccagggccaaagtagctttcaatcagcccaccagggtgctacgtcggttttgcagttgc
tatgacaacaccctggcgttagggccccttccatggtaatgacccaatgaccccaaagt
tactactccttctctggaagtgtctgcataaacctccccttaatctacatgtaattaaaa
gtagtaataaacatgactgcaaaactgccctgagctgctaccccactgtcaatggggtagc
cctgctctgcctcttcaagaaagctgttttcttctacctctggcttgccgttgaattctt
tcctgggcaaagccaagaactctcgtgggctaagctccacttttggggctcacctgcccca
catcactaccacccgttaagagatttaatttgggtatcagttcgtggtctgtctcccca
tggtatagaaggtccttgaaggaaagaactttgcttttccacttctctatcccagtgcc
cagaatgggcctttggaaagcatcgagcagcctctcttgctcagtgggcactgaaatggc
actcggagctcagtacccagataaaggacaccccccagataaaggacaccacccttccc
ccgcgcaggcctcgggaaagggcgaggccgtgcgaggcca >IGR3309a
ggaaagaactttgcttttccacttctctatcccagtgcccagaatgggcctttggaaag
catcgagcagcctctcttgctcagtgggcactgaaatggcactcggagctcagtacccag
ataaaggacaccccccagataaaggacaccacccttcccccgcgcaggcctcgggaaag
ggcgaggccgtgcgaggccacaggaagggcgtggcctcgaggacctggggcggggtc
tggcagggtcagaggtttctggaaaggcctttgacctgtgggcgtgttcctagaggtcag
gtggtgagaatggcggggtcagcggacagcagtggggctacaggctgtgtctgtggctgc
cctggcttagggctctggctggcccctccttttccgacctggtctggcagagcagcccgc TABLE 5-continued aggaccagctcgcaaggctcctggggccagtggggctctgtcctgtgaggcggtccctcc
gcaaggacagagtcagagagaggctggtgagtcaaggatgtgctctgagcggggtctgg
gtgcgtcaaatgatgtcttggacgtaatatctaaggctgacgctactttgaagaggttta
acttttgtgaagattctttattctaaactcggggggaaactttttttttttgatctgcagt
caaatgctctaccactgagctatacccttctgccaactt >IGR3310a
aggctggtgagtcaaggatgtgctctgagcggggtctgggtgcgtcaaatgatgtcttg
gacgtaatatctaaggctgacgctactttgaagaggtttaacttttgtgaagattcttta
ttctaaactcggggggaaactttttttttttgatctgcagtcaaatgctctaccactgagc
tatacccttctgccaactttttttttttgtaaagcatttgggggttgtgagaagataag
tggtaggaactggccatgggtatttggcaagctcaaagttttttgtttttaaggcacttt
tcagtgtctttctgaaagtgcgtttataacatggaggatcagcccctccccacaccccag
cttggtcctcccttctcttactcttctctgaaaagtccatctctttctcttgaaatttgc
agccaacggagcctcactaaagtaatgacccaaactgcttttgtacccagtgggctcaca
gctgtcatcttgcctgcttctttgatttcaagaagcttaaggcaagctgcttatgctaga
tttactgtcctcaccttccattcttaaattttttgacgcagtgagtctcccccaactaatt
ctctggaattgtctggtaaagtgttctgggtcctcctagtggccaaacccagtagacact
tcggacagtttttttttttttcctctagcgaagcacttcgt >IGR3311a
tttgatttcaagaagcttaaggcaagctgcttatgctagatttactgtcctcaccttcca
ttcttaaattttttgacgcagtgagtctcccccaactaattctctggaattgtctggtaaa
gtgttctgggtcctcctagtggccaaacccagtagacacttcggacagtttttttttttt
cctctagcgaagcacttcgtgattcaagttctccttttatttcgcctccctggctcctt
ttcatcagcctaggcttctcatatatatgttcccctagtctagtttgtttccttttcacgg
tagtactgtatgctataggaggaaggatctttacttccactgctttaacatgtatatgtt
tatgatttattgaattgtcttttttgtactcaaatctttctcttgagctctgttttagacc
cttatatccancnttctagaggacatacccacctggaccaacatctagaataggtgtcag
aaattattcaacaaatgatcacaaatagggcctgatgtaggaaaaatacaattacaatga
ctgttaacctttttggggtgacagaccctcttgagacccatatgaaatttcagggtcttta
tcccttttaaaaagtgcacacaaaattttgcctgtttcaaagcttcctagaccttctgtag
ttcaagaatttgaggctttggttagagcttcctgatatga >IGR3312a
acaaatagggcctgatgtaggaaaaatacaattacaatgactgttaacctttttggggtga
cagaccctcttgagacccatatgaaatttcagggtctttatcccttttaaaaagtgcacac
aaaattttgcctgtttcaaagcttcctagaccttctgtagttcaagaatttgaggctttg
gttagagcttcctgatatgataatgataaaatgaaaagtgtgttttcacagataagcat
cagatttngaaacttacaatgggaatgcattgtattccagccgtcatcaaacgttaaccc
tgattaatcacatcaggctgatttatggaaacattgtctttagcagtagcaacatagaat
gaaaaatctggagccctagagttgaaatataccccagcagactccctgtggctaaaatga
gacataccaaaaccagaatctaacggccacagcaagatgagggcttggtcatgtatccct
gtgttactaactaccataaggttttctttcctgtaagcagaaaccaggtcctgaaaaaca
tcacagaaactacagctggaaaatttcctgttgaccctgatagactactacttgacaccag
ccgaccgatctgctggctgccaccatggtcctgccacaattctgatgggacagagaatt
ggccttactttctttcctgataaatagccatagacctcaa >IGR3313a
gttttctttcctgtaagcagaaaccaggtcctgaaaaacatcacagaaactacagctgga
aatttcctgttgaccctgatagactactacttgacaccagccgaccgatctgctggctgc
ccaccatggtcctgccacaattctgatgggacagagaattggccttactttctttcctga
taaatagccatagacctcaagccagccagttttggccagcttatagagactgtacacaaa
ctgtctttgtgccctgtagttcacctttttgatgcaaagagccaaattcaccttacttta
atgctaaaaccccaccccaaagtgaacatggaatgcatgttacatatatgtttacccact
gcacacatgcttgacttccctcatgaatattcacagattcctttaagcctgctaaatata
acccagctaattttttatattttttggtacagatagggtttcatcatgttggtcaggctggt
cttgagctcctgacctcaagtgatccaccccgcctcggcctcccaaagtgctgggattaca
ggcgtgagccaccgcgcccagcctcatgatgatttctaaacacagattcccctgatccat
gtgggcgtgtgtgtatggcggcggcaattttaggagtcaactataacaaggtcccaagga
agtgagaggggagccaagctccaggggacagaagagggaa >IGR3314a
tgatccacccgcctcggcctcccaaagtgctgggattacaggcgtgagccaccgcgccca
gcctcatgatgatttctaaacacagattcccctgatccatgtgggcgtgtgtgtatggcg
gcggcaattttaggagtcaactataacaaggtcccaaggaagtgagaggggagccaagct
ccaggggacagaagaggggaagggaagggcaatggtgagtttctttttttagggcccatgt
gtatgcaggaaacacttcctcccccatttttgtactttggtgtgtaatgaaatagccaagca
acacttttctcttttttctgaacttgctgaggaaaaaggaaaaaagggatccaaatctatc
tgtcttggagcaaagatgacagaattgcaggcagtgacatgatcaaatgtgctgaggaca
ggagcaaaccacgcacaccctggagtatccctgtaaggcataaatacccagcttcctattc
ccttttggagtatgtccttttggttttcctgggaggttgcattcccccaatttgtagattg
tttctcccctctgaaaatagttttttttccccttttcttcctctgtgcatctcatggtcttt
tgttaacatttcaaagagagtttctgattaactgtgggttgcatgtttcacagtccaaat
agccttagcctggtcagagaccagggcctgcttcagataa >IGR3315a
tggttttcctgggaggttgcattcccccaatttgtagattgtttctcccctctgaaaatagt
ttttttttcccttttcttcctctgtgcatctcatggtcttttgttaacatttcaaagagag TABLE 5-continued tttctgattaactgtgggttgcatgtttcacagtccaaatagccttagcctggtcagaga
ccagggcctgcttcagataatttacgaagttgttgctattaagagtgtaacctggctggg
tgcagtagctcacgcctgtaatcctagtactttgggaggccgaggtgggtggatcacttg
aggccaggagtttgagaccaacctgaccaacatggtgaaatcccgtctctactaaaaata
caaaaaattagccaggcgtggtggcacacttctgtgattccagtgacttgagaggctga
ggcaggagaattgcttgaacctaggagtnggaggttgcagtgagccaaggttgcgctact
gcactccagcctgggcgacagagtgagactctcttggggaaaaaaaagagtgtaatctg
ctcccctccagctggacgggaatacagataaggttttgaggcctggtgccttgtaggagc
cctgagtgatcaggcagtcgtagaagtgcatgaggtgccaggggtttccttccagcagaa
cttgccttctttatttgttgggccagtgacttctcagttc >IGR3316a
gagtgagactctcttggggaaaaaaaagagtgtaatctgctcccctccagctggacggg
aatacagataaggttttgaggcctggtgccttgtaggagccctgagtgatcaggcagtcg
tagaagtgcatgaggtgccaggggtttccttccagcagaacttgccttctttatttgttg
ggccagtgacttctcagttccagagttattgccttgatggtccatgagtgctgttttgag
attgacccccactctctcttgaatgaaatatatttcatctcttttcttcttgtattgata
tgttaatatttattttttaataaaggtgagatctaaggagacattatccactttgtttaa
acccttctcttggctgccatgatccaactatcttctggttttcttctatctctgcctac
aacttctcaataccgtagtctcctgtggccctcctttcccaatcctcagttatggctcag
agttctttatagccattttttttttctctgaaggctcatgacttccaaatacttgatat
tccaaatacttgatatcagtatattgatattgataactcttgagtctttaattctagctt
ttattactttccaacttccagctccagctctacttagatggcccgcaagttcttccattt
taatagatccctaaccaggttcattatacttccctttaaat >IGR3317a
tttttttctctgaaggctcatgacttccaaatacttgatattccaaatacttgatatcagt
atattgatattgataactcttgagtctttaattctagcttttattactttccaacttcca
gctccagctctacttagatggcccgcaagttcttccattttaatagatccctaaccaggt
tcattatacttcccttaaatggttcctatttctgttttacttatctttgcaaatggcaaa
aatgactgatcattctcctagcctcagctaggaggcgattctctcttctttcttcactgt
tcttgataactattcatgtgaacttccttttttcactttgcttggtattttttcccccactg
ttccaggaaattggtaactcgtttctattttgctcttaatctttagagcaaccttagagt
ttaggtatatagttcccatttttactcatgagaaaacaggcttacttttaaaattattaat
tacacaaagaaaatgtacatgcatgttacctctaagcaaatttaggcaaaacagaaatag
aataaaatattacagtgcccctccctcccattactctcctatgtctttagcagtggttc
tcagctggggagattttgtcccctagggcagtggtccccagacattttggcaccagggac
agtttcatggaagacaattttttccatggacgggggttggt >IGR3318a
gcatgttacctctaagcaaatttaggcaaaacagaaatagaataaaatattacagtgccc
cctccctcccattactctcctatgtctttagcagtggttctcagctggggagattttgtc
ccctagggcagtggtccccagacattttggcaccagggacagtttcatggaagacaattt
ttccatggacgggggttggtgggggatgctttcagaatgaaactgttccaccttagatca
tcaggcattacactctcataaggagcatgcaacctacatccctcgcatgtgcatgcatag
ttcacagtcgagtttgcgctgctatgagaagttaatgttgcagctgatctgacaggaggc
agagttcaggcagtaatgctcactcgcctgctgctcacctgctgtgcagcccggttgcta
acaggccactgaccggtactgatttgcagcctgggcattggggacctcttccctaggaga
tatttgacaaggtctggagacaattttgattgccttgacttaggggatactactggaata
aaactacctattgggcactaaaatatatatataaatatatataatatataaaaatata
tataaatatatatgtaatatataaaaatatataaaaatatatataatatataaatatata
taaatatatataatatataaaaatatatataaatatat >IGR3319a
caattttgattgccttgacttaggggatactactggaataaaaactacctattgggcacta
aaatatatatataaatatatataatatataaaaatatataataatatatgtaatat
ataaaaatatataaaatatatataatatataaatatatataaatatataataatatataa
aaatatatataaatatataatatataaaatatatataaatatataaaatatatataaaa
atatataaaatatatataaatatataatatataaaatatataaatatatataaataaaaat
atatataaatatataatatataaaatatataaatatataatatataaatatatacaa
tatataaatatacaatatataaatatataaatataatatataatatattatatata
atatatatattatatattatatatattatatattatataataatataataatatattata
tataatataattatatttttaaatatatattttaaatatgtttaatatatattat
attttaaatatatataatatatattaatatatattttaaatataataatatattattta
atatataatatatatttattatattanattatattaaatatatattaattatatttaatat
atatttaatatattaatatatatttaatatatatttaatat >IGR3320a
tttaaatatatattttaaatatgtttaatatatattatatattttaaatatatataatat
atattaatatatatttaaatatataatatatattatttaatatataatatatatttatt
atattanattatattaaatatatattattaattaatatatatttaatatttaatattaatata
tatttaatatatattaatatatatttaaatatattttaatataattaatattaaatatat
taaatataaaaatatatttaaatatatattataatatatatataaacaacaccatcaccc
acagttcccattacctgtttatagtcttgtttccttcctttgttcttaacaccttctaag
gtattatatcattaccttattatgtttattgttatggtttggagatattttcaaattttt
actctgtatgatatgtatttggcacagtattcaacaaaatactgtatttggaatccaagt
gtttattatggcttttttaaaaaaaaattaatacatagantaaaaataaaatacataacgcta TABLE 5-continued gccaaataaatatggattttgcactgtaattgtaaaaaaatgtgttttgcactggtaatc
caaaggaaacaaataaaaataaaaaaaataattctcctatcccaaatgtcagtagtgcc
caggttgaaaaactgctctggaggtaatctgttatatatc >IGR3321a
aaaaattaatacatagantaaaaataaatacataacgctagccaaataaatatggatttt
gcactgtaattgtaaaaaaatgtgttttgcactggtaatccaaaggaaacaaataaaaa
taaaaaaaataattctcctatcccaaatgtcagtagtgcccaggttgaaaaactgctctg
gaggtaatctgttatatatcattttccataactacactatccaatactgtaaccactagc
cacgtgaggctatttacactgaaattaattaaaattaaataaaaattctgttcctcagtg
ctattaagtacattttttaagtgttcaatggccacacatggctacagaattaaacagcata
gattatagaacatttcaatgattgcagtaagatttgttggacagtgctttaggtatatat
cacgcaaatagatgttctgttttacataaatagaatcatacatactgttctatagttttg
ttaatatgtcttgaagattttccatctaagtatatataactaaaatatgtactaagtac
ataactaaatatttaagtttaatggtctgtgatatagttcagttttattaaattcata
aatttaatttattacagcaatgtagtttaattttgccttttttttaagtttatgtgtatgg
actcatataatacatattattttttatccagtttatttttac >IGR3322a
ttccatctaagtatatataactaaaatatgtactaagtacatataactaaatatttaagt
ttaatggtctgtgatatagttcagttttattaaattcataaaatttaatttattacagcaa
tgtagtttaattttgccttttttttaagtttatgtgtatggactcatataatacatattat
ttttatccagtttattttactcaatgctatgtttttaagatatatccatgttatttctgt
atatctatagttattccttttaagtgctttatggtattccattggatgaccataccatag
gttgtttatccatttgactttttgtgggcatttgagtttcttccagtttgggatataatg
aataattctggcatgaatattctgtacttatttcctgaaagtatattttttatgcaggtta
tacatgggaatggaattattggtccactgaaatttactagattatgccactttcttaaaa
tagttgcattcttcttcttattattattttttgagatggagccttgctctgtcgcctaggc
tggagtgcagtggtgtgatctcagctcactgcaactttcatctcctgggttcaagcgatt
ctcctgcctcagcctcctgagtacatgggattacaggtatgtgctatcatgcccagctaa
tttttgtatctttggtagagatgggtttcaccatgttcc >IGR3323a
ttattattttttgagatggagccttgctctgtcgcctaggctggagtgcagtggtgtgatc
tcagctcactgcaactttcatctcctgggttcaagcgattctcctgcctcagcctcctga
gtacatgggattacaggtatgtgctatcatgcccagctaattttttgtatctttggtagag
atgggggtttcaccatgttccaggctagtcttgaactcctgacctcaagtgatctgcccgc
ctcggcctcccaaagtgttgggattacagacgagagccacgttgcctggccgcatttttt
tcttaatagcagtatgtgagagttccctctaaactgcatcctaagcagtatctttgtat
ttgtcagacttttaaagttcaaacttcctggtggcatgtggttgtatcccatagttttat
tttgcacttcttgattatgaatgatacagaacactttcatatatttatcagtcttttga
atattttcttttatgagttctttttgagtctctagaccatttatctattgagttgtttta
ttaatttgtagaaagactttgtatattctggatacaagccttttattggttgtatatgtt
gtgtagatattctccacctttagtggctgcttgccttttctgtctctcttaatggtgatt
tttgatttgttttgagaaatatcaacctttcttcttaaga >IGR3324a
tttttgagtctctagaccatttatctattgagttgttttattaatttgtagaaagactttt
gtatattctggatacaagccttttattggttgtatatgttgtgtagatattctccacctt
tagtggctgcttgccttttctgtctctcttaatggtgattttttgattttgttttgagaaat
atcaacctttcttcttaagattattcaataacagcaaagtaacaatgagaaactactgtc
agtttaagtgggtttagctcctcagttccaaggtatataatcacttaaatataacctgga
aaaaaaaacaaaatatttctctaaatcatggtctttgtaaaaaaatgaattaaatcttc
tctgttctctcatattgtattccaattntggatgtagccaccagtgagatgagcaaatgtc
taaatttggatacatcacttaaatatttagaacgtcattggtttcttcaaacagtggaaa
attcttgccatgcctacccttatagactttgtataatgctattatcaatgctagctggatac
taacttagaagatgattatacattttttaaacagctcttcctatcctggttctacaataag
acactgactccaccacatactggatgacctagagcaagttaacttaatgacactgtgcat
taatttactttgctataacaatgggataatatatcaattc >IGR3325a
atagactttgtataatgctattatcaatgctagctgatactaacttagaagatgattata
cattttttaaacagctcttcctatcctggttctacaataagacactgactccaccacatac
tggatgacctagagcaagttaacttaatgacactgtgcattaatttactttgctataaca
atgggataatatatcaattcatgttattattgcagctattgtcagatagaacaattgag
agaatttataaacaaaatgactaagcagatgagttagttttcctaattggccagcttaag
ggagagagttataagggctatagagttctagatgaaattataacatcacctccaaagagag
agcaacttacctctggtcaggctttcttcctgaagtgtttcttgggagagggtgagcaga
gtggtcaagagcctatctatttatttcagtgggctaagcatagatgtccttgagangaag
acttccttggtcctttaggtaatgtaagtccttcaacttcattctttttcaaaattgttc
tgactattctgggtcccttttatttccatgtgaatttttaggatcagcttgtcaatttctn
caacaagcccagctaagatttgataggttttaccttgttcttgctcttaggagccaagc
agcccatcttttcaccattaagtatgatgttagttgtgaga >IGR3326a
aatgtaagtccttcaacttcattctttttcaaaattgttctgactattctgggtcccttt
tatttccatgtgaatttttaggatcagcttgtcaatttctncaacaagcccagctaagatt
tgataggttttaccttgttcttgctcttaggagccaagcagcccatcttttcaccattaa
gtatgatgttagttgtgagagtttcgtatctgtctttatcacattaagaatgttctcttc TABLE 5-continued tattcctagtctgtggagaggttttttgtttgtttgtttgtttgtttgtttgtttttta
gacagagtctcactctgtcatccaggctggagtgcagtacaatctctgctctctgctctc
tgcaacctccacctcccgggctcaagtgattctcctgcctcagtctcctgagtagctggg
attacaggtgtgcgccaccacatccagctaattttttgtattttagtagagacgggggttt
taccgtgctggccaggctggtttcaaattcctgacctcaggtgatccacccgcgttggcc
tcccaaagtgctgaggttacaggtctgaaccatcatgcccagcctagattttttttaaa
aatcataaataggtgttgaattttgtcaaatgcctttcctgcgtctgtggaaataatcat
gtgtcctttattctatatagtctcttacattaattgcatg >IGR3327a
tttcaaattcctgacctcaggtgatccacccgcgttggcctcccaaagtgctgaggttac
aggtctgaaccatcatgcccagcctagattttttttaaaaatcataaataggtgttgaa
ttttgtcaaatgcctttcctgcgtctgtggaaataatcatgtgtcctttattctatatag
tctcttacattaattgcatgttaaaccaacctcatattcttgcagaaatctcacttggtc
atggtgtatacattctttttacatattcctggatttagtttgctaataattaaggattct
catgatgatgttcatgagggttttgtagttttctttttgtatgatgtctttagcttttggg
attagggtaataaacatcttagatttagttgggatctgttctcttctctatttttctgaag
actttgtgaaggattagcattattttttggttaaatatttgataaaattcaccagtgaag
ttatctgggcctagaattctctttatgggaagattttacatttctaattcagtttcttta
ctttttataggcctatttagattgttctgtatattttttagttcattttggtaatttgta
cctttntaggaacttttccacttcatattagttgcctgctttgttggcataaagatgttt
acagcatttccttgtaatttctataggatncagtagtcta >IGR3328a
ctttatgggaagattttacatttctaattcagttcttttactttttataggcctatttag
attgttctgtatattttttagttcattttggtaatttgtacctttntaggaacttttcca
cttcatattagttgcctgctttgttggcataaagatgtttacagcatttccttgtaattt
ctataggatncagtagtctattctttctttcgtcccctttatgggtaattttttatcttct
ctatttttttcttggtcagtctaaaggtttgtcaattttgttgatcttttcaaataatca
gcctttaggtttctttggttttctctattttttccattttctatttttgttgatttctgctc
ttatccttattatttcatttattttgcttgctttgatcattttaacttgcccctcctttt
ttagtttcttaaggtgagagcctgggttattgattagagacttttttttaaatataggca
tttaaagctatacattttcttctaagtaccacttgaaactgcatcccatataattttaata
tattgtagttttgttttttatttagttcaaaatatattttagttttcatngtgaattcttc
tttgacctatggttatttagaagaatgttgttcaatttccaaatatttgaagatattca
agatttctttctattttttatgtttaattccatgtggttg >IGR3329a
tctaagtaccacttgaaactgcatcccatataattttaatatattgtagttttgttttttat
ttagttcaaaatatattttagttttcatngtgaattcttctttgacctatggttattta
gaagaatgttgttcaatttccaaatatttgaagatattcaagatttctttctatttttta
tgtttaattccatgtggttggacagcatattctgtatgagttaaatctttaaaatttatc
aggacttggtttgtgacctaacatatggtctttcctggaggatgtctgtgtgagcttgaa
aggaatgtgtattctgctgtttttttgatggagaattctataggtgtcaggtgaaattggt
tgatagcattgttcagatcttgtatatccttcctgattttctgtgtggttgttttaccag
ttcataagagtgaggtattcaaaatatccagctattattgaattacctattctctcttc
agcactgtcaattgttgttttatgtctttcggggctttcattaagtgatatacatctata
attattacatctttttgatatattgactcttgttacatttataaaatgtttccttttgtc
tctagcagtatttcttattctaaagtttatttttgtcagatattaatacagccaccccatc
tctcttgtagttgttgtttgcatggtacatcttttacctct >IG3330a
tatgtctttcggggctttcattaagtgatatacatctataattattacatcttttttgata
tattgactcttgttacattataaaatgtttccttttgtctctagcagtatttcttattct
aaagtttatttttgtcagatattaatacagccaccccatctctcttgtagttgttgtttgc
atggtacatcttttacctcttttttttttttaagacagggtctcacctgttgccaggc
tggagtgcagtggcgtcatctcagctcacccaaacctctgctcccgggttcaagtggct
ctcctgcctcagcctcccaagtagctgagattacaggcacataccaccacgcccagataa
ttttgtattttttagtagatatgaggtctcaccatgttggccaggctggtctcaaactcc
tggcctcaagtgatccacccaccttggcctcccaaagtgctgggattacaggtgtgaacc
actgcgcctggcttacctttttttttttttttaacctaaaaacctttttagattatttg
aatctaaagtgtgtctttgtatgtagcatgtatttggatcttgtttttatttattcaatct
gaaaagctctgagtttgctaagaaaaatcaaggtggttcagtggtagagaatctcagagc
agaagggtttcagatagattgtttagggatgatctctttg >IGR3331a
ttttttttttttttaaccttaaaaaccttttttagattatttgaatctaaagtgtgtctttgt
atgtagcatgtatttggatcttgttttatttattcaatctgaaaagctctgagtttgcta
agaaaaatcaaggtggttcagtggtagagaatctcagagcagaagggtttcagatagatt
gtttagggatgatctctttgtagtggtgacataaagctgatactaaagactagaaggaat
caaagtgtgaagaagggaagggaaaggaaagagcattataaatcaagagaacagaccctg
agtgataggagagcttgacattttttgaagaactgaaagagaagctggttcatagtgagca
aagggaatgtggtggcagatgaagggtagtatgctaaacaagggtgacactgcggaatct
tgaagtctatggtgaaaagtttgtattttattgaaaagtagtgtgaagtcattgaaatt
tttgaagagtagaagaaaacttgatccaatttgtgtgtacaaaatctgaatctaaaccttg
gtaagcaagaaatagcatattgtaggctgggcatggtggctcacgcctgtaatcccagct
ctttgggatgccgaggcgggtggatcgcctgaggtcgggatttcgagaccagcctggcca
gcatggtgaaaccccgtctctactaaaaatacgaaaacta TABLE 5-continued >IGR3332a
tgatccaatttgtgtgtacaaaatctgaatctaaaccttggtaagcaagaaatagcatat
tgtaggctgggcatggtggctcacgcctgtaatcccagctctttgggatgccgaggcggg
tggatcgcctgaggtcgggatttcgagaccagcctggccagcatggtgaaacccgtctc
tactaaaaatacgaaaactagctgggatggtggcaggtgcctgtaatcccagctactct
ggaagctgaagcaggagaatcacctgaacccaggaggtggaggtttcagtgagccgagat
tgcgccattgcactccagcctgggtaacagagtaagactccatctcaaaaaaaaaaaaa
aaaaaaaaaaaaaaaaangaagcangaaatagctgtattgtaatttttttcctaattc
aaattaaatttgacttanatactcttccctgatgagctggtgagaaatgtattgtcagtc
actattagggctgtgtcacctcagaagttcccaccaaactaacaaggttgctagaaaata
gaaggaaaacttctaactttgagtttgtcatggtcattgggctagtatgtggatgtttgt
ccatatccacagtttccttaaaggatggtagttttctgcttctatgccactttggggttc
atgaaactggagatgacaagtcctggtactcttttggtg >IGR3333a
tcagaagttcccaccaaactaacaaggttgctagaaaatagaaggaaaacttctaactttt
gagtttgtcatggtcattgggctagtatgtggatgtttgtccatatccacagtttcctta
aaggatggtagttttctgcttctatgccactttggggttcatgaaactggagatgacaag
tcctggtactcttttggtgtaccatggaaccatcattttttaggtctaattctttctta
gagatgctgcctgtgagtgtggtagtcagttctctttattatacttttctttttcctc
cctcttctgaccttctctttgttttcagaaattactctagaatgtatactcttctcttg
ttaccattaaaaacttaacaggattttactttgattttacaaaagacacgaagtgcaat
tacctggattagcttcttctatgaagaaaaataaagcagcctaacagggtagagattgat
agagtctactatcttaaatagagagactaggaaactctctcttagtagagtcatttgagt
agaatcctgaaggcagtaaaagaaaataacattcacgcaaaggaataacaaatacaag
gtgtctgggaatggagagtagttggtgtttttgaggaaaagtaaaggtcaggctactgtg
gctggaacgaatgaacaaggttaaggagctttagtagatg >IGR3334a
gagagactaggaaactctctcttagtagagtcatttgagtagaatcctgaaggcagtaaa
agaaaataacatttcacgcaaagggaataacaaatacaaggtgtctgggaatggagagta
gttggtgtttttgaggaaaagtaaaggtcaggctactgtggctggaacgaatgaacaagg
ttaaggagctttagtagatgaagtagccagatatcagagcagtgcagaaccttggaagtcg
ggggaaggactttgaggttttactatgagtgagatcatagaagattattttgtagagtag
actacagaggggacaagggcatgcaagaaaaaaccagactggacacctagatattgaact
tactaaataaagacattaagccaactgttataaatattttcaaagaactaaagacaacta
tgtctaaagaattaaagtttgagaatgatgtcttacttaatagagaatatcaattaaaag
atataagttatttacaaaccagatggatattctggttgacaaatacaataactgaaatg
taaaattcactaaagggactcatcatcctttttgaacttgcaaaataaagaatcagtgaa
cttaagatcacccagtctgagaaacagaaagaaaaaagaatgcagaaaaatgaacagagc
catacagatttgtgagaaaccatcacatgtatcaatacat >IGR3335a
cagatggatattctggttgacaaatacaataactgaaatgtaaaattcactaaagggact
catcatcctttttgaacttgcaaaataaagaatcagtgaacttaagatcacccagtctga
gaaacagaaagaaaaaagaatgcagaaaaatgaacagagccatacagatttgtgagaaac
catcacatgtatcaatacatgcataaggagaatcccaaaagaaaagaaaaagaaagggca
gaaagaatatttgaagatatgatggcaagaaactacaaatttgataacaaacactaatct
gcacactaagaaactagtgaactccaagtaggataaacctagagacacgtcatagtcaaa
ctattgaaagccaaagatcaagaaagaatcttggccaggccacagtggctcatgcctgtaa
taccagcactttgggaagctgaggtggacagattacttgagctcacaagtttgagagcag
cctgggcaacatggagaaaccctgtctctacaaaaaatacaaaaattagccaggcgtggt
gttgcatgcctgtagtcccagctactcgggaggctgagatgggaggaaatagaggttgtg
gtgagccaagattgtgccactgcacttcaggctgggcaatagaaccagacctctcaaaaa
gaaagagagaggccgggcgcggtgctcacgcctgtaatcc >IGR3336a
cctgtctctacaaaaaatacaaaaattagccaggcgtggtgttgcatgcctgtagtccca
gctactcgggaggctgagatgggaggaaatagaggttgtggtgagccaagattgtgccac
tgcacttcaggctgggcaatagaaccagacctctcaaaaagaaagagagaggccgggcgc
ggtgctcacgcctgtaatcccagcactttgggaggctgaggcgggcggatcacgaggtca
ggagatcgagaccatcctggctaacacggtgaaccccgtctctactaaaaatacaaaaaa
ttagccggccgtggtagngggcgcctgtagtcccagctactcgggaggctgaggcaggag
aatgcgtgaacctgggaggcggagcttgcagtgagccgagatcgcgccactgcactcca
gcctgggcgacagagcgagactccgtctcaaaaaaaaaaaanaaaaagagagagagaga
gagagaataattgaaaatagaaagagaaggcagcaaggcatgttcaataaaattaacag
ctttcttttcattagaaactgtggataccacagaaggcagagggatgatgtattcaaagt
gctgaaagaaaaggactgtcaactaggagttgtatattcagcaaagctagtcttcaaaaa
ttaaggtgaatttaaaacattcccatgtaaacaaaaacag >IGR3337a
gaaagagaaggcagcaaggcatgttcaataaaattaacagctttcttttcattagaaact
gtggataccacagaaggcagagggatgatgtattcaaagtgctgaaagaaaaggactgtc
aactaggagttgtatattcagcaaagctagtcttcaaaaattaaggtgaatttaaaacat
tcccatgtaaacaaaaacagaattcttcactagcagacatgccctataagaaatatgaaa
gggggttctttaggttgaaatgacaggacactaaatagtaacttgaatccacacagagaa
ataaagagtactggtaaagataactctataggtaaatgtaaagtcagtataaatattat
ttttgtttgtaacctttttcttctatctgattcaaagacaactacataaagcaataatt
ataattatatatttaataatgtgtaaggatattcttttaatgccaataataataaagga TABLE 5-continued gaggagaaggaatggagctgtacgggaacagggttttatatattattgaaattacgtca
atattactctgagctagattgctttaagttaagacgttaattgcagtccccagggcaaat
actaataaaagaactaaaaaaagtggtaaaatagctaacaagtggattaaaatgntatac
tagaaaactaacacaaaagaaggcagtaatgaaaggatag >IGR3338a
tacgggaacagggttttatatattattgaaattacgtcaatattactctgagctagatt
gctttaagttaagacgttaattgcagtccccagggcaaatactaataaaagaactaaaa
aagtggtaaaatagctaacaagtggattaaaatgntatactagaaaactaacacaaaga
aggcagtaatgaaaggatagaggaacataaaggcatgtacagaaaacagcaaaatggcaa
atgtaaatctcatcagtaattccaagaaatgaaatgggcactacagtcaaaggcataga
ttaagagaatgaataaaataacataatccaactatatgctatctatgagacaaatatata
ttcagagaaacaaataggttgaaagtgaaaagatggaagaagatacagaatacaacaatt
ctccaaaaaagaactggagaggctgtgctagtattagacaaaatagactttgagacaaaa
attgttactagagaccaagaagaavattttttatattaaaaaggtcagtccatcaaaaaaa
cataacaattataaacatatgcacctaagagcagagcctcaaaataaatgaggcaaaacc
cagcagaattaaaggaaaatagacaattcaacaataatagttggagatgtcaatacctca
ctttgaaaaatggatacaacatataggtagatgatcactgg >IGR3339a
agaacattttatattaaaaaggtcagtccatcaaaaaaacataacaattataaacatatg
cacctaagagcagagcctcaaaataaatgaggcaaaacccagcagaattaaaggaaaata
gacaattcaacaataatagttggagatgtcaatacctcactttgaaaaatggatacaaca
tataggtagatgatcactggggaactagaagacttcagcaacactataaaccaactagtc
taatagacaccctntaaaacactctccccaacagtgtaaggcacattcttctcaaatacac
atttaaaattctttctcccctttctttcttttttttttttggacaggatattgttctgt
ggtctaggctggagtgcagtggcatgatcacagctcactacagctgcaaagtcctgggct
caagcagtcttcctgctccagcctcccaaatatctgggactataggtgtgcaccaccatg
cttcgctaatattttgttttagtagagaaagggtctcactatgttgcccagactggtct
tgaactcttggcctcaagcagtcctcccacctggcttcccagataggaattataggcat
gagctactgcagccaacctctagacctcatgtcagaccataaaataagtctcaataaact
aagaattcaaattatataaagtatgttttaactacaa >IGR3340a
tagtagagaaagggtctcactatgttgcccagactggtcttgaactcttggcctcaagca
gtcctcccacctggcttcccagataggaattataggcatgagctactgagccaacctc
tagacctcatgtcagaccataaaataagtctcaataaacttaaaagaattcaaattatat
aaagtatgttttaactacaacagtagaaattcgaaaccaataacaagaaaatttgggaaa
ttcactaatatgtggaaatttgttaacatactcctacataaccagtaggtcaaataagga
atcacaagagaaattagaaagtattttgagatgagtgtaaatgaaaatacaatataccaa
aacttagaggatgtagctaaagcagcgcttagaggaaaatttatggatgtaaacacctgt
atttaaaaaggagaaaaatattaaattaaaacataatcttttaccctaggaaatcagaa
agactaacttgagccaaggcaaacagaaggaaataaagactancacagaaataaattaa
gtagagaatagaaacacagtaaaaaaaatcagtaaaaccaaaagtggatttaaaaaaaa
tcaacaaaatgtacaaacctttggctaggttaaccaataaaaaaaatacaggaggactcaaa
taactcaactattagaagaaaatattggactaaatcttcc >IGR3341a
caaacagaaggaaataaagactancacagaaataaattaagtagagaatagaaacacagt
aaaaaaaatcagtaaaaccaaaagtggatttaaaaaaaaatcaacaaaatgtacaaacct
ttggctaggttaaccaataaaaaaaatacagaggactcaaataactcaactattagaagaa
aatattggactaaatcttcctgaccttacgtaggtaatgatctctcatatattacatcaa
aggcatacagaatcaaagaaaaatttgatatattggttttaaatatatattggacttcat
caaaattgtaaaattctgatgttttacaggacgctgttgagaaagtgcagacagactcca
gaataagtaggtggtggcggggggagggcagcggatatttgcaaatcacatatctgaactt
gtatcaagaatatagagaactgttacaactcaacantaaaaagacaaccctatttatt
tatttatttatttatttttgagacaaagtctcgctcttgtccccaggctggagtgcagtg
gcacgatctcagctcactgcaacctccgcctcccaggttcaagcgattctcctgcctcag
cctcccaagtagctggtattacaggcgcctgccaccacgcctggctaattttttgtattt
tagtagagatggggtttcactatgttggccaggttggtct >IGR3342a
gacaaagtctcgctcttgtccccaggctggagtgcagtggcacgatctcagctcactgc
aacctccgcctcccaggttcaagcgattctcctgcctcagcctcccaagtagctggtatt
acaggcgcctgccaccacgcctggctaattttttgtattttagtagagatggggtttcac
tatgttggccaggttggtctcgaactcctgacctcaggtgatccacctgcctgggcctcc
caaagagctgggattacaggcgtgagccaccatgcctggccaacaactcaatttaaaagt
gggcaaagaatttgaatagaaatttcctcagaaaagatatacaaatggccaatataca
tgaaaagatgctcagcatcactaatcattagggaaatgcaaatcaaaaccacagtgagat
accacttctatacagtaggatggctaaaataaaaaaagacagaaaattactagtgttgg
tgaagatgtggagaattagaaacttcattcattgctggtggggttgtaaatgatgcag
ccaccttggaagacagattggcagctxxtxatacagttaaacatacagttaccatatgac
ccaactatttcattcctgggtacatacccaagataaatgaaaatatatatccacacaaaa
acttgtacatgaatgtacatagcagaattattcataatta >IGR3343a
aaacttcattcattgctggtggggttgtaaatgatgcagccaccttggaagacagattg
gcagctcctcatacagttaaacatacagttaccatatgacccaactatttcattcctggg
tacatacccaagataaatgaaaatatatatccacacaaaaacttgtacatgaatgtacat TABLE 5-continued agcagaattattcataattaaccagagagtagaaacaacccaaatgcccatcaactgacc
aataaataaacaaaatgtggtatatccatactatggaatattattcagcaaaataaaag
gaatgaagtgctgatgcatgctgtaatatggatgaaacttagaaaaattatactaagtga
aagaagccagacacaaaaggccacatattgtttaattccattatatgtaatatctagaa
tagccaaatgcatagaaatagatattagactagtggttgccaaggggatggaaaggggga
tcagggagtgattgctgatggatacgggctttctctttgatatgacaaaaatgctctgga
attagaggtgatggctgtgtaatttaaaactacgctttacttacatgaattttatggta
tgtgaattatcagtaaagctgttaagaaaagtaagttcactcaattttacatttaagaca
aaagatccccaattgtggtggatggaagaacatcctcact >IGR3344a
gatacgggctttctctttgatatgacaaaaatgctctggaattagaggtgatggctgtgt
aatttaaaactacgctttacttacatgaattttatggtatgtgaattatcagtaaagct
gttaagaaaagtaagttcactcaattttacatttaagacaaaagatccccaattgtggtg
gatggaagaacatcctcactcttcatcaaggccagtacattaaccaaagaaacatttgat
gaaggagtccgtcagttcttgaatttcctgatgaagaaacaactggttggctagcaaaga
aaagctgtactttagaaatttatctttttgtttcttagatggtctactaaactatgcttc
aaacataggattgtagaaatctgaatataatagtaattacaagaaatacaaatgcattga
acttagcaattagaagagacatattcacttaatgttcgacaaatactcagtgtatattat
atgccaggctctgctgtaaatacatgggcatcagcaagcaaactagacaagaatttcca
ccctcatggaactaatgttctagttaagggaaaaagtccaataaaatacactggttaagt
atgtttttgtatgttaaaatatattaggtgctatgaataaaatagagtagtgtgagcaa
ggctgggggtgctgggaagttggaatttaatgttctcagat >IGR3345a
acatggggcatcagcaagcaaactagacaagaatttccaccctcatggaactaatgttct
agttaagggaaaaagtccaataaaatacactggttaagtatgttttttgtatgttaaaat
atattaggtgctatgaataaaatagagtagtgtgagcaaggctgggggtgctgggaagtt
ggaatttaatgttctcagattcaataaaaaatttagctatattatgtttacaaaagacac
ataaaactcgagaatacagaaaggttgagtgtaaaggaattatatatatgctagacaatt
agaaaaagtatgctgatatggcaatattagtatcagacaaaatgatctttaaggcaaat
gatgttaaggatgctaaacttgcttgggcattataatacagcatataaatattaaaacaa
atacaaaattacaaggaagaattgataaagctgtaattattgtgggatattttaatgtac
ctattcagtaaatagagcaaatcaaaaaataaagcaaataagtaaagcaaatcaaagcac
agtaaggttattgataaatttgaacaacacatttcacaaggttgatacaatgaacacatag
agaaccctgcatgttcatttcaagtgcttatagaatatcttttaaaaattccccacatac
taggttataaaacaaacctcaggttcccaaaataaggaac >IGR3346a
atcaaaaaataaagcaaataagtaaagcaaatcaaagcacagtaaggttattgataatttt
gaacaacacatttcacaaggttgatacaatgaacacatagagaaccctgcatgttcattt
caagtgcttatagaatatcttttaaaaattccccacatactaggttataaaacaaacctc
aggttcccaaaataaggaactaacagaccatgttctctgataatcattccttgaagtca
gaaagtaacaaaagtgactttaaaagctcatgttttaaaaatttaaatatacagttaaa
tagctaatgaaaaagttatgatgtcactatagaaattagaaaatattagaatggaatgaa
tataataaaaatatatatcagatcttgagggatgcatttagattgtcttggagcaatatt
tacagcccttatttatttatttattttttattattattatactttaagtttagggtaca
tgtgcacaatgtgcaggttagttacatatgtatacatgtgccatgctggtgcgctgcacc
cactaactcgtcatctagcattaggtatatctcccagtgctatcctcccccatcccccc
accccacaacagtccccagagtgtgatgttccccttcctgtgtccatgtgttgtcattgt
tcaattcccacctatgagtgagaatatgcggtgtttggtt >IGR3347a
gttacatatgtatacatgtgccatgctggtgcgctgcacccactaactcgtcatctagca
ttaggtatatctcccagtgctatcctcccccatcccccacccccacaacagtccccaga
gtgtgatgttccccttcctgtgtccatgtgttgtcattgttcaattcccacctatgagtg
agaatatgcggtgtttggtttttgttcttgcgatagtttactgagaatgatgatttcca
gtttcatccatgtccctgcaaaggacatgaactcatccttttttatggctgcatagtatt
ccatggtctgtatatgtgccacatttcttaatccagtctatcattgttggacatttggctt
ggttccaagtctttgctattgtgaataatggcgcaataaacatacatgtgcatgtgtctt
tatagcagcatgatttatagtcctttgggtatatacccagtaatgggatggctgggtcaa
atggtatttctagttctagatccctgaggaataccacactgacttccacaatggttgaa
ctagtttacagttccaccaacagtgtaaaagtgttcctatttctccacattctctccagc
acctgttgtttcctgacttttaatgatcgccattctaactggtgtgagatggtatctca
ttgtggttttgatttgcatttctctgatggccagtgatgg >IGR3348a
tccctgaggaatcaccacactgacttccacaatggttgaactagtttacagttccaccaa
cagtgtaaaagtgttcctatttctccacattctctccagcacctgttgtttcctgacttt
taatgatcgccattctaactggtgtgagatggtatctcattgtggttttgatttgcatt
tctctgatggccagtgatggtaagcattttttcatatgtttgtgcataaatgtct
tcttttgagaagtgtctgttcatgtccttgcccacttttttgatggggttgtttgtttttt
tcttgtaaatttgtttgagttcattgtagattctggatattagccctttgtcagatgagt
aggttgcgaaaattttctcccattttgtaggttgcctgttcactctgatggtagtttctt
ttgctgtgcagaagctctttagtttaatcagatcccattttgtcaattttggcttttgttg
ccattgcttttggtgttttagacatgaagtccttgcctatgcctatgtcctgaatggtaa
tgccaggttttcttctagggtttttatggttttaggtctaacgtttaagtctttaatcc
atcttgaattgatttttatataaggtgtaagcaagggatccagtttcagctttctacata
tggctagccagttttcccagcaccatttattaaataggga TABLE 5-continued >IGR3349a
gacatgaagtccttgcctatgcctatgtcctgaatggtaatgcctaggttttcttctagg
gtttttatggttttaggtctaacgtttaagtctttaatccatcttgaattgattttata
taaggtgtaagcaagggatccagtttcagcttctacatatggctagccagttttcccag
caccatttattaaatagggaatccttcccattgcttgttttctcaggtttgtcaaag
atcagatagttgtagatatgcggcattatttctgagggctctgttctgttccattggtct
atatctctgttttggtaccagtaccatgctgttttggttactgtagccttgtagtatagt
ttgaagtcaggtagcgtgatgcctccagctttgttcttttggcttacgattgacttggcg
atgagggctcttttttggttccatatgaactttaaagtagttttttccaattctgtgaag
aaagtcattggtagcttgatggggatggcattgaatctgtaaattaccttgggcagtatg
gccatttttcacgatattgattcttcctacccatgaggatggaatgttttccatttgttt
gtatcctcttttatttccttgagcagtggtttgtagttctccttgaagaggtccttcaca
taccttgtaagttggattcctaggtattttattctctttg >IGR3350a
ggggatggcattgaatctgtaaattaccttgggcagtatggccatttttcacgatattgat
tcttcctacccatgaggatggaatgttttccatttgtttgtatcctcttttatttcctt
gagcagtggtttgtagttctccttgaagaggtccttcacataccttgtaagttggattcc
taggtattttattctctttgaagcaattgtgaatgggagttcactcatgatttgggtctc
tgtttgcctgttgttggtgtataagaatgcttgtgattttttgcacattgattttgtatcc
tgagactttgctgaagttgcctatcagcttaaggagattttgggctgacacaatggggtt
ttctagatatacaatcatgtcatctgcaaacagggacaatttgacttcctcttttcctaa
ttgaatacccttatttccttctcctgcccaattgccctggccagaacttccaacactat
gttgaataggagtggtgagagagggcatccctgtcttgtgcagttttcaaagggaatgc
ttccagtttttttccattcagtatgatattggctgtgggtttgtcatagatagctcttat
tatttcgaaatacgtcccatggatacctaatttattgagagtttttagcatgaagggttg
ttgaattttgtcaaaggccttttctgcatctattgagata >IGR3351a
gagggcatccctgtcttgtgccagttttcaaagggaatgcttccagttttttttccattca
gtatgatattggctgtgggtttgtcatagatagctcttattatttcgaaatacgtcccat
ggatacctaatttattgagagtttttagcatgaagggttgaattttgtcaaaggcct
tttctgcatctattgagataatcatgtggttttgtcattggttctgtttatatgctgga
ttacatttattgatttgcgtatattgaaccagccttgcatcccaggatgaagcccactt
gatcatggtggataagcttttgatgtgctgctgattcggtttgccagtattttattga
agattttgcatcaatgttcatcaaggatattggtctaaaattctccttttggttgtgt
ctctgcccggctttggtatcaggatgattctggtctcataaaatgagttagggaggattc
cctcttttctattgattggaatagtttcagaaggaatggtaccagttcctccttgtacc
tctggtagaatttggctgtaaatccatctggtcctggactcttcttggttggtaagctat
tgattattgccacaatttcagatcctgttattggtctattcagagattcaacttcttcct
ggtttagtcttgggagagtgtatgtgtcgaggaatttatc >IGR3352a
aatagtttcagaaggaatggtaccagttcctccttgtacctctggtagaatttggctgta
aatccatctggtcctggactcttcttggttggtaagctattgattattgccacaatttca
gatcctgttattggtctattcagagattcaacttcttcctggtttagtcttgggagagtg
tatgtgtcgaggaatttatccatttcttctagattttctagtttatttgcgtagaggtgt
ttgtagtattctctgatggtagtttgtatttctgtgggatcagtggtgatatcccttta
tcattttattgtgtctatttgattcttttctctttttttcttttattagtcttgctagc
ggtctatcaattttgttgatccttttcaaaaaaccagctcctggattcattgattttttga
agggttttttgtgtctctatttccttcagttctgctcttattttagttattcttgcctt
ctgctagcttttgaatgtgttgctcttgcttttctagttcttttaattgtgatgttagg
gtgtcagttttggatctttcctgctttctcttgtgggcatttagtgctataaatttccct
ctacacactgctttgaatgcatcccagagattctggtatgttgtgtctttgttctcgttg
gtttcaaagaacatctttatttctgccttcatttcatcat >IGR3353a
ttgctcttgcttttctagttcttttaattgtgatgttagggtgtcagttttggatctttc
ctgctttctcttgtgggcatttagtgctataaatttccctctacacactgctttgaatgc
atcccagagattctggtatgttgtgtctttgttctcgttggtttcaaagaacatctttat
ttctgccttcatttcatcatgtaccagtagtcattcaggagcaggtttgttccgtttccat
gtagttgagcggttttgagtgacattcttaatcctgagttctagtttgattgcactgtgg
tctgagagacagtttgttataaattctgttctttttacatttgctgaggagagctttactt
ccaagtatgtggtcaattttggaataggtgtggtgtggtgctgaaaaaaatgtacattct
gttgatttggggtggagagttctgtagatgtctattaggtccacttggtgcagagctgag
ttcaattcctgggtatccttgttgactttctgtctcgttgatctgtctaatgttgacagt
ggggtgttaaagtctcccattattaatgtgtgggagtctaagtctctttgtaggtcactc
aggacttgctttatgaatctgggtgctcctgtattgggtgcatatatatttaggatagtt
agctcttcttattgaattgatcccttaccattatttata >IGR3354a
gttgactttctgtctcgttgatctgtctaatgttgacagtggggtgttaaagtctcccat
tattaatgtgtgggagtctaagtctctttgtaggtcactcaggacttgctttatgaatct
gggtgctcctgtattgggtgcatatatatttaggatagttagctcttcttattgaattga
tccctttaccattatttatagccttaaatgactaaatttgaaaggaagaaagcctggaat
taatgagctaagctttgttaaggtaagtgaaaattctgtattgtattttaaggttcaagt
gctgaaatcactttatttttttaattgcaaaatttgggttttttcttccatttaacctgttg
aacccaaatctgccttattgacctccttgggtctcttctaccccttgaattgttagtgaa TABLE 5-continued ctccagtgacatatatagtgacaaacaggaagtatgctgaaatctgaggcaataaaatag
gtttacaacctagtgtaattctagacagaattaatagtggtctggcatttagaatgagaa
agtggtggctgtttctcagttggaccagccttccagatatatattaatagctgtacatta
tcgtttaattcagaagaaagtagcctggatgttaaagggttatgtgaacataatatgaaa
aacagcatgtggaatagagacatagagaatgaaaagaaa >IGR3355a
ctagacagaattaatagtggtctggcatttagaatgagaaagtggtggctgtttctcagt
tggaccagccttccagatatatattaatagctgtacattatcgtttaattcagaagaaag
tagcctggatgttaaagggttatgtgaacataatatgaaaaacagcatgtggaatagaga
cataggaatgaaaagaaaaaacttcattggatcataaagcaacaaggctcacaactg
gagcattctctcttctgagaaatctgctctgacatccttctcctctccccaacctcccaa
taggtgtatcttccatttgttccatagtagcccgtgattcgctccactacagaagttggt
tatatttaattttaattgtccatttacatctatattgcttttattaaactgtttccctca
gtaagcaaagactgattttaaatcattttgcattttcaagcccaactgtggtgctgag
tacttaatttgatctgtattgaatgaaattgaagttattgaaggaagaaaggatgaacta
atgaattaaagcaattgattatatttttttctctgtggccctgaggattagccctagag
cacatatgtagaacatgcagacagatatactgggttctgtatgaagataaatcttaact
gccatgggctggcaagatggccgaataggagcagttctgg >IGR3356a
gaatgaaattgaagttattgaaggaagaaaggatgaactaatgaattaaagcaattgatt
atatttttttctctgtggccctgaggattagccctagagcacatatgtagaacatgcag
acagatatactgggttctgtatgaagataaatcttaactgccatgggctggcaagatgg
ccgaataggagcagttctggtctgcagctcccagtgagatcaatgcagaaggcaggtgat
ttctgcatttccaactgaagtacccagctcatctcaacccatggagggcgacctgaagca
gggtgggttgtctcacccaggaagtgcaagggttcggtgaacttttcccatggtctttgc
aacccatagaccaggagattccctcgggtacctacaaaccagggccccgggtttcaagca
caaaactgggtgaccatttgggcagacaccgagataactgcaggagtttttttttcatacc
ctagtggcacctggaacaccagcaagacagaacggttcactaccctggaaaggggggctga
agccagggagccaagtggtctagctcagtggatcccaccccatgaagcccagtaagcta
agatccactggcttgaaattcttgctgccagcacagcagtctgaagttgaccaggaatgc
tcaagcttgggtgggggcggatgggggggtgagggggt >IGR3357a
agcaagacagaacggttcactaccctggaaggggggctgaagccagggagccaagtggtc
tagctcagtggatcccaccccatgaagcccagtaagctaagatccactggcttgaaatt
cttgctgccagcacagcagtctgaagttgaccaggaatgctcaagcttgggtgggggcg
gatgggggggtgagggggtggggcattgccattactgaggcttgagtaggcaggtttcc
cctcacagtgtaaacaaagctgcctggaagttcaaactgggcggagcccaccacagctcc
acaaagcctctgtagacagactgcctctctagattcctagtctctggacagggcatctct
gaaagaaaggcagcagccccagtcaggggcttatagataaaactcccatctccttgggac
agagcacttggggtaaggggcagctgtgggtgcagcttcaacagacttaaacattgctgc
ctgctggttctgaagagagcagtggatctcccagcacagccatagagctctgctaaggga
tagactgcatcctcaagtgggtccccaaaccccatgcttcctgactgggagacacctccc
agtaagggtcaacagacacctcatacaggggagctccgcctggcctctggcgggtgcccc
tcagggacgaagcttccagaggaaggaacatgcagcattc >IGR3358a
agtggatctcccagcacagccatagagctctgctaagggatagactgcatcctcaagtgg
gtccccaaaccccatgcttcctgactgggagacacctcccagtaagggtcaacagacacc
tcatacaggggagctccgcctggcctctggcgggtgcccctcagggacgaagcttccaga
ggaaggaacatgcagcattctctgtagcctctgctggtgatacccaggcaaacagggtct
ggagtggacttccagcaaactacaacagacctgcagcagagggacctgagtgttagaagg
aaaactaacaaacagaaagaaatgacgtcaacatcaacacaaaggacgtccacacagaaa
ccccatccaaaggtcaccaacatcaaagaccaaggtagataaatccatgaagatgaggaa
taccagcgcaaaaggctgaaaattccaaaatccagaatgtctcttctcctccagaggat
cacaactcctcaccagcaagggaactaaactggatggagaatgagtttgacaaattgaca
aaagtaggcttcagaaggtgggtaataacaaattcctctgagctaaaggagcaagttcta
acccaatgcaaagaaactaagaaccttgaaaaaaggttagaggaattgctaactagaat
aaccagtttagaaaaaagcataaatgacctgatggagctg >IGR3359a
ggaactaaactggatggagaatgagtttgacaaattgacaaaagtaggcttcagaaggtg
ggtaataacaaattcctctgagctaaaggagcaagttctaacccaatgcaaagaaactaa
gaaccttgaaaaaaggttagaggaattgctaactagaataaccagtttagaaaaaagca
taaatgacctgatggagctgaagaacacagcacaagaacttcacgaagcatacacaattt
caatagctgaatcgatcaagcagaagaaaggatattagagattgaagatcaacttagtga
aataaattgtgaagacaagattagagaaaaagaatgaaaagaaatgaacaaagcctcca
ggaaatatggaactatgtgaaaagaccaaacctacgtttgattggtgtatctgaaagtga
ggggaaattggaaccaagttggaaaacactcctcaggatattatccaggagaacttccc
caacctagcaagacaggtcaacattaaaattcaggaaatacagagaacaccacaaagata
ctcctcaagaatagcaaccccaagacacataatcatcagattcaccaaagttgaaatgaa
ggaaaaaatgttaagtgcagcagagagaaaggtcgggttacccacaaagggaagcccat
cagactaacagtggatctctgcagaaactctacaagtcag >IGR3360a
acattaaaattcaggaaatacagagaacaccacaaagatactcctcaagaatagcaaccc
caagacacataatcatcagattcaccaaagttgaaatgaaggaaaaaatgttaagtgcag TABLE 5-continued ccagagagaaaggtcgggttacccacaaagggaagcccatcagactaacagtggatctct
gcagaaactctacaagtcagaagagagtggggccaatattcatcattcttaaagaaaata
attttcaagccagaattttatatccagccaaactaagctttataagtgaaggagaaataa
aatcctttccagacaagcaaatgctgagagattttgtcaccaccaggcctgccttataag
agctcctgaaggaagcactaaatatggaaaggaaaaactggtacaagccactgcaaaaac
ataccaaattgtaaagaccatcaacactatgaagaaactgcatcaactaatgggcaaaat
aaccagctagcatcataatgacaggatcaaattcacacataacattattaaccttaaatg
taaatgggctaaatgccccaattaaaagacacagactggcaaattggataaagagtcaag
acccatctgtgtgcaatattcaagagacccatctcacgtgaaaagacatacataggctca
aaataaggagatggaagaatatttcaggcaaatggaaa >IGR3361a
acaggatcaaattcacacataacattattaaccttaaatgtaaatgggctaaatgcccca
attaaaagacacagactggcaaattggataaagagtcaagacccatctgtgtgcaatatt
caagagacccatctcacgtgaaaagacatacataggctcaaaataaggagatggaagaat
atttatcaggcaaatggaaagcaaaaagaagcaggggttgcagtcctagtctccaataaa
agagactttaagccaacacagatcaaaaaagacaaagaggggcattacataacggtaaag
ggatcaatgcaacaagaagagctaactatcctaaatgtttatgcacccaatacagggcac
ctagactcataaagcaagttcccagtgacctacaaagagacttagaccccccataataa
tagtgggaagactttaacaccccactgtcaatattagacagattaatgagacagaaaatt
aacaagcatattcaggacttgaactcagctctggacaaagtggacctaatagacatctat
ggaactctccaccccaaatccacagaatatacattcttctcagcaccacgtcacacttat
tctaaaattgaccacataattggaagtaaaacactcctcagcaaatgcaaaagaacagaa
ataataacaaacagtttctcagaccacggtacaatcaaat >IGR3362a
gaactcagctctggacaaagtggacctaatagacatctatggaactctccaccccaaatc
cacagaatatacattcttctcagcaccacgtcacacttattctaaaattgaccacataat
tggaagtaaaacactcctcagcaaatgcaaaagaacagaaataataacaaacagtttctc
agaccacggtacaatcaaattagaacttaggattaagaaactcacccaaaactgcacaac
tacatggaaactgaacaacctgctactgaatgactactaggtaaataatgaaattaagag
agaaataaattctttgaaaccaatgagaagaaagacacaatgtgccagaatctctgggac
acagctaaagtagtgtttagaggaaaatttatagcactaaatgcccacaggagaaagtgg
aaaagatctaaaattgacaccctaacatcacaatgaaaagaactagagaagcaagagcaa
acaaattcaaaagctagcgaagacaagaaataactaagatcagagcagaattgaaggag
atacaggcacaaaaaaccctccagaaaatcaaaatcagtgaatccaggagctggttttttt
gaaaagaataacaaaatagactgctaaccagactgataaagaagaaaagagagaagaatt
gaatagacacaataaaaaatgataaagggggtattcccac >IGR3363a
aagacaagaaataactaagatcagagcagaattgaaggagatacaggcacaaaaaaccct
ccagaaaatcaaaatcagtgaatccaggagctggttttttgaaaagaataacaaaataga
ctgctaaccagactgataaagaagaaaagagagaagaattgaatagacacaataaaaaat
gataaagggggtattcccactgatcccacagaaatacaaactaccttcagagaatactat
aaaacacctctatgaaaataaactagaaaatctagaagaaatggataaattcctggacaca
tacaccctcccaagactaaaccaggaagaagttgaatctctgaatagaccaatgacaagt
tctgaaattgaggcagtaattaatagcctgccaaccaaaaaagcccaggaccagatgga
ttcacagccgaattctaccagaggtacgaagaggagctggtaccattccttctgagacta
ttccaaacaatagaaaggagggaatcctccctaactcatttatgaggccagcatcatc
ctgataccaaaacctggcagagacacaacaaaaaatgaaaatttcaggccaatatccctg
atgaacattgatgcgaaaaccctcaataaaataatggcaaaccgaatccagcagcacagc
aaaaagcttatccaccacaatcaggttggctttatttctg >IGR3364a
gggaatcctccctaactcatttatgaggccagcatcatcctgataccaaaacctggcag
agacacaacaaaaaatgaaaatttcaggccaatatccctgatgaacattgatgcgaaaac
cctcaataaaataatggcaaaccgaatccagcagcacagcaaaaagcttatccaccacaa
tcaggttggctttatttctgggatgcaaggctggttcaatatatgcaaatcaataaacat
aatccatcacataaacagaaccaatgacaaaaaccacatgattatctcaatagatgcaga
aaaggcctttgacaaaattcaacaccccttcatgctaaaagctctcaataaactaggtat
tgatggaacacatctcaaaataataagagctattttgacaaacccacagccaatatcat
actcaatgggcaaaagctggaagcattccttttgaaaaccgacacaagacaaggatgccc
tctctcaccactcctattcaacgtagtattggaagttctggccagggcaatcaggcaaga
aaagaaataacgggtattcagataggaaagaggaagtcaaattgtctctcttttgtaga
tgacatgattgtatatttagaaaaccccatcatctcggctgggcacagtggctcacgcct
gtaaccccagcactttgggaggctgaggcgggtggatcac >IGR3365a
acgtagtattggaagttctggccagggcaatcaggcaagaaaaagaaataacgggtattc
agataggaaagaggaagtcaaattgtctctcttttgtagatgacatgattgtatatttag
aaaaccccatcatctcggctgggcacagtggctcacgcctgtaaccccagcactttggga
ggctgaggcgggtggatcacaaggtcaggagatcgagaccatcctggctaacacagtgaa
accctgtgtctactaaaaatacaaaaaaaaaaaaaattagccaggtgtggtggtgggca
cctgtagtcccagctacatgggaggctgatgcaggagaatggtgaaacccaggaggtgg
agcttgcagcgagcctagattgtgccactgcactccagcctgggctacagagagaggctc
catctcaaaaaaaaaaaaaacaaaaaccaaaaaaaaaaaaaacccatcgtctcagcccaaa
atctccttaagctgacaagcaacttcggcaaaggctcaggatacaaaaccaatgtgcaaa TABLE 5-continued aatcacaggcattcctatacaccaataatacacaaacagccaaatcatgcatgaacatcc
atgcacaattgccacaaagagaataaaatacatgggaataaaatttacaagggatgtgaa
ggacctcttcaaggagaactacaaaccactgcccaaggaa >IGR3366a
aacttcggcaaaggctcaggatacaaaaccaatgtgcaaaaatcacaggcattcctatac
accaataatacacaaacagccaaatcatgcatgaacatccatgcacaattgccacaaaga
gaataaaatacatgggaataaaatttacaagggatgtgaaggacctcttcaaggagaact
acaaaccactgcccaaggaaataagagaggacacaaacaaatggaaagacattccatgct
catgaataggaagaatcaatatcgtgaaaatggccatactgcccaaaataatttatagat
ccagtgctatccccatcaagctaccattgactttcttcacagaattagaaaaaactactt
taaatttcatatggaaccaaaaaagaacctgtatagccaagacaatcctaagcaaaaaga
acaaagctggaggcatcatggtacctgacttcaaactatactataaggctacagtaagca
aaacagcatggcagtcgtaccaaaacagatatatagaccagtggaatagaacagaggcct
cagaaatagcaccacacatctacaaccatctgatctttgacaaacctgacaaaaacaagc
aatggggaaggattccctatttaaaaatggtgttgggaaaactggctaaccatatgcag
aaaactgaaactggacctcttctttacaccttatacaaaa >IGR3367a
caaaacagatatatagaccagtggaatagaacagaggcctcagaaatagcaccacacatc
tacaaccatctgatctttgacaaacctgacaaaaacaagcaatggggaaggattcccta
tttaaaaatggtgttgggaaaactggctaaccatatgcagaaaactgaaactggacctct
tctttacaccttatacaaaaattaactcaagatggattacagacttaaatgttagaccta
aaaccataaaaaccctagaagaaaacctagacaatgccattcaggacataggcatgggca
aagacttcatgactaaaacaccaaaagcaatggcaacaaaagccaaaatagacaaatggg
atctaattaaactaaagagcttctgcacagcaaaagaaactatcatcagagtgaacaggc
aacctacagaatgggagaaaattttttgtaatctttccatctgacaaagggctaatatcca
gaatctacaagggactcaaacaaatttacaagaaaaaaacaaccccatcaaaaagtgggc
aaaggatatgaacagatgcttctcaaaggaagacttttatgcagccaacaaatatatgaa
aaaaagctcattatcactagtcattagtgaaatgaaaatcaaaaccacaacgagatacca
tctcatgccagttagaatggcaatcattaaaaagtcagga >IGR3368a
caaatttacaagaaaaaaacaaccccatcaaaaagtgggcaaaggatatgaacagatgct
tctcaaaggaagacttttatgcagccaacaaatatatgaaaaaagctcattatcactag
tcattagtgaaatgaaaatcaaaaccacaacgagataccatctcatgccagttagaatgg
caatcattaaaaagtcaggaaacaacagatcctgagaggatgtggagaagtaggaatgc
tttacactgttggtgggagtgtaaattagtccaaccattgtggaagacagtgtggtgat
tcctcaaaaatctagaacctgaactaccatttgacccagcaatcccattactgggtatat
acccaaaggattataaatcattctactataaagacacttgcacatgtatctttattgcag
cactattcacaataacaaagacttggaaccagcccaaatcaaatgtccatcaatgataga
ctggataaagaaaatgtggcacatatacaccatggaatactatgcagccataaaaaagga
ttagttcatgtcctttgctgggacatggatgaagctggaaaccagcattctcagcaaact
aacacaggaacagaaatcgaacaccgcatgttctcactcataagtaggagttaacaat
gagaacacatggacacaggggagaggaacttctcacactgg >IGR3369a
acatatacaccatggaatactatgcagccataaaaaaggattagttcatgtcctttgctg
ggacatggatgaagctggaaaccagcattctcagcaaactaacacaggaacagaaatcg
aacaccgcatgttctcactcataagtaggagttaacaatgagaacacatggacacagggg
agaggaacttctcacactgggccagtcagggtgggggactaggggagggatagcatta
ggagaaatacctaaggtagatgttgggttgatgggtgcagcaaaccaccatggcacatat
atacctatgtagcaaacctacacattctacacatgtatcccagaacttaaaatatatata
tataaatatcttaactgccaaaaagtggaaggaactgcttgacaggtagtacactccatt
tctatccaaggagatgttctggcataaagtagacaaccaacaaatggggatactacagag
tcacctcattttattgaattcagtaaacttattaacatctgttacatactaggatgctg
tactaagcaaaaagtgaaacatttatggcgtgtgtccagaatatcttatggtctatttg
gggatggtggtggtagactagatatttaaacagacatcttcagttgattgtgtggcaagt
cataaaatggatgttcagagtactgtgagagctcagggaa >IG3370a
tcagtaaacttattaacatctgttacatactaggatgctgtactaagcaaaaagtgaaa
catttatggcgtgtgtccagaatatcttatggtctatttggggatggtggtggtagacta
gatatttaaacagacatcttcagttgattgtgtggcaagtcataaaatggatgttcagag
tactgtgagagctcagggaaatgtactcaaatgctggatttataattttataatcactgt
agctgaccaaagggcaacttctaatttgactgcaatatgttttcttttagttataccatc
ataaaaacctgttttagataatcttgggaagattttacactcttctcttttccttttttt
ttttttttttgagacagtcttgctctgtcaccccggcttgagtgcagtagcatgatttcg
gctcactgcaacctcctcctcctgggttcaagtgattctcctgccccagcctcctgagta
gctgggattacaagcatccgccaccatgccctgctaattttgtattttagtagggacag
ggtttcaccatgatggctaggctggtctcgaactcttgatgtcaggtgatctgcctgcct
cagcctcccaaaatgctgggattacaggtgtgagccaccatgaccggctgatttcacact
cttagactttgctgcgctaactcatgttaggaaaatcttt >IGR3371a
ccaccatgccctgctaattttgtattttagtagggacagggtttcaccatgatggctag
gctggtctcgaactcttgatgtcaggtgatctgcctgcctcagcctcccaaaatgctggg
attacaggtgtgagccaccatgaccggctgatttcacactcttagactttgctgcgctaa
ctcatgttaggaaaatcttttcttctgttgacactattgccagggtcctgtctttgacttt TABLE 5-continued ggctagcatgggagaatccttcatgactgctgtaaaaaataagctttgtaaattccttca
attatttggtaagagccttggactaggagttagacgtctaggctccaattctgatctgcc
cctcttttctatatgaccttgacctaagttccttgattactttgggaatcagttttctt
atctgaagaatgggaaaccaaaacattggctggacttttctcttgggtattgtgaaggca
gatgagatgatgatacctgtcgaaattatcagggaaggtataagttatctgggactctag
tgtacatttaactatggtcagcggtgtaaaacataacattgtcatgaaaacatgttagg
aagcagatgtgatcgcatgaatgtgaattgtgagtgagaggtaggacaactgtctntctg
tctgtgctagagaccttgggactagtgggtgatgaaaggt >IGR3372a
cgaaattatcagggaaggtataagttatctgggactctagtgtacatttaactatggtc
agcggtgtaaaacataacattgtcatgaaaacatgttaggaagcagatgtgatcgcatga
atgtgaattgtgagtgagaggtaggacaactgtctntctgtctgtgctagagaccttggg
actagtgggtgatgaaaggtgggatgggttttctcaccctaatctttatttctctttcg
attctaattctggacagtgttcaaattctacacggtttngtgacagtagtttgaaaagg
gatttgtagagcttctctaagcgacctccctgattgctagccattcctaccctctcttc
tttccaatgtccagactcctctcacaaacaagcctagttgaatctgccaactttaagaag
ttgttagaggaagaaagggcaggaaagcttggatacaaggcatcaaagaccaagaaggag
acattgagtagtgtccttgaggactctctggaccgtctggaaaactggaggtctatgag
ggcctctgctgtggagagggtatcaaactcattgctgtgctctaaatgtttgtgtccccc
tggaattcatatgtcaaaatcataacctgcaaggtgatagtattagaaggtgaggtcttt
tgggaggcgattagtgcccttgtcaaagagacccaagaga >IGR3373a
ggactctctgaccgtctggaaaactggaggtctatgagggcctctgctgtggagaggg
tatcaaactcattgctgtgctctaaatgtttgtgtcccctggaattcatatgtcaaaat
cataacctgcaaggtgatagtattagaaggtgaggtcttttgggaggcgattagtgccct
tgtcaaagagacccaagagagcttcctgaccccctccactatgtgagaacacagctagaa
ggctccatatgtgaaccagaaagcaggctcttaccagacagtgaatctgctgggtgcctt
catcttggacttcgagcctccaaaactgtgaaaaataaatttctcttgtttataagtcac
tcagtcaaaggtattttgttagagcagcccggctagacaaagacacctgtaaaaatggga
aaggaggtggatggggttgaaagggctgcttagggtccttgagagaccttcagatcccct
gataatatgaatgcttgggaccttggcttgaagggccagatttggttgagaaagtattc
cagtcctcaaacctggcccttaaatgcacctctgggtctctctcagtgttacagttatat
tgaacacttattttattgatggctaattaggtgctaggcattaagaccattatttatat
tacttttgataatttttattaaatggctatagaaaaaa >IGR3374a
ccttggctttgaagggccagatttggttgagaaagtattccagtcctcaaacctggccct
taaatgcacctctgggtctctctcagtgttacagttatattgaacacttattttattga
tggctaattaggtgctaggcattaagaccattatttatattacttttgataatttttta
ttaaatggctatagaaaaaaattaagtattttctcagtctttcatcatatctgaattatt
gcactcactttgattaattcatgggacattttcttaatagtttgttagtttattgccttt
ggaaagttcctttttcctgtatttggcatgattagcattaatgttttgtactcacttgt
ttctggttcagtactagtgatacatgtggaaaaatgaattaatatatgccccttcttgg
tagagtgtagtctattaaaggaaaatttaaaatgtaaatcagtgattttaatatggtagt
ggtatgtgcaaagtctggtggcaacacagaagacgcaattaactctgctttaggacagag
aggattgagagttcacaaggaaaggactcttgaattagaatttcatgtagacagtggtag
taagagaagtttaggctgatgctgtttcatgtgcaaatatacagtaaaaaaattacact
gtattttgagaacagcaataattttttctattagaagaac >IGR3375a
gcaacacagaagacgcaattaactctgctttaggacagagaggattgagagttcacaagg
aaaggactcttgaattagaatttcatgtagacagtggtagtaagagaagtttaggctga
tgctgtttcatgtgcaaatatacagtaaaaaaattacactgtattttgagaacagcaata
attttttctattagaagaacataaaatttgaaaaaggaaactatggtgttcaagatgtta
atatatgcagggcttgtattatggagggtcaggtggatcatgacatagaacttggatttt
gctttgttaggcagttctcaaacttaattgtgcataggaatcacctgaaaatcttggaaa
agtacagatcttgattcagtaagttagagtacagcctgagagtctgtatttctaacaatc
tccctgctacactgggagtagcaaggatgtacagaatagaaagcactgtaaggttcaatc
aggggagtgagccagttaccttggacatgatagaaagatgactggaagagaaacgctgtt
tctttccagccccatagaaattgaattgttaccgttgtacaagtcctgtgtaagggtggc
ttccctcatagagcttgcagatgtgaggaggaatgttcctgagagataagaagctgttga
atggtttatgtttgtcatttgtgccaaccaagaaaaggact >IGR3376a
tggacatgatagaaagatgactggaagagaaacgctgtttctttccagccccatagaaat
tgaattgttaccgttgtacaagtcctgtgtaagggtggcttccctcatagagcttgcaga
tgtgaggaggaatgttcctgagagataagaagctgttgaatggtttatgtttgtcatttg
tgccaaccaagaaaaggacttttgtttcagttctgaggggtgaaggaggtgggcataagg
agtggggctagtgcctacagccagagggagactggtacttaagcgagagcctgttgctctg
tgctccccaggcaccacagaagcagcagaggcttttctgtaggtactaccatggcaagag
ggctccacagcttctcatcactcacttggaagaggatgatgagtgggacatcatcaggta
ttataatgtcatgtctgaggaggaaatcaaaaggatgaaggagattgtgaagcccaaagt
aagtttctcagttggttctcaccacattttccctctgccacttcctgagacctaccttgc
tgtcattattttagagaaacttaaggaaaaagctggtagcagagttgcaagcagatttat
tttttaatgacctggtcctccagaagaaataaatatcattatgtattatttggtacctca
gatgagaattttaaaaatctctttaaatttttattaatttt TABLE 5-continued >IGR3377a
accacattttccctctgccacttcctgagacctaccttgctgtcattattttagagaaac
ttaaggaaaaagctggtagcagagttgcaagcagatttatttttaatgacctggtcctc
cagaagaaataaatatcattatgtattatttggtacctcagtagagaattttaaaaatct
ctttaaattttattaattttcaacattttatcttagttttaaagattgcatatggctttt
tagggtttgttgccttttctttttaattgacataattgtatatatttatggggtacagt
gtgatattttgatatgtatatacaatgtgtaatgattaaatcacggtaattagcatatct
atcacctcaaacatttatctgtgtgtgtgtgaacattcaaaatcttctcttctagatatg
tgaaaataaaaaattaattgttaattatatttaccctacagtgctatagaacactagagc
ttattcctcctatctagcttttacatttgtatctattaaccaacctttggctatcccacc
cttctcttatacttccctgcctctagtaaccactattctattctcttctatgaaatcaa
ttttttttagcttcaatatgtaagtgagaccatgtgctatttatctttctctgcctggct
taatttcccttaacataatgtcctccaggctcatccatgt >IGR3378a
ttacatttgtatctattaaccaacctttggctatcccacccttctcttatacttccctg
cctctagtaaccactattctattctcttctatgaaatcaattttttttagcttcaatatg
taagtgagaccatgtgctatttatctttctctgcctggcttaatttcccttaacataatg
tcctccaggctcatccatgttgctgtaaatgagagaatttcattctttttgtggttaaat
aatatttcatatatatataccagattctctttatccattcatgttaatggacacttacgt
tgattccataccttggctattgtgaagagtgctacaataaacatgggattgcagatattt
ctttgacatactaatttccttcccttggatatgtacctagcggtaggattgctggaaca
taaagtagttctattttagttttttttgagaacctccataatgttttctataatggcttta
ttaatttacattcctaccaacagtgtataagagttcacttttctccacagccttgccagc
atttgttattttttgtcttttttaaaataggtgtgagaaaatatcttattgtggttttgg
tttgcatttgcctgatgattagtgatgttgagcattttttcatatacctgttggccatttt
ctatgtcttcttttaagatgtctgttcagcttatttgctt >IGR3379a
cagtgtataagagttcacttttctccacagccttgccagcatttgttattttttgtcttt
tttaaaataggtgtgagaaaatatcttattgtggttttggtttgcatttgcctgatgatt
agtgatgttgagcatttttcatatacctgttggccatttctatgtcttcttttaagatg
tctgttcagcttatttgcttattttttaatcggattattattattttttgctattgagtt
gtttgagttctttgcatattctggctatcaattccttgtcagatgaatagtttgcaaata
tttcctcccattctgcaggttgtctcttcactctgttgattgtttccttttgctgtggaga
aggtttttttgtttgatataatctcatttgtttattttttgcttttgttgcctgtgcacaa
aagagatccttgccataaaaatcttttgcccaaaggatatgaacagacacttctcaaaaga
agacatttatgcagccaacagacatatgaaaaaatactcatcatcactggtcatcagaga
aatacaaatcaaatcacagtgagataccatctcacgccagttagaatggcaatcattaa
aatgtcaggaaacaacagatgctggagaggatgtggagaaataggaacgcttttacactg
ttggtgggagtgtatattagtccaaccattgtggaagaga >IGR3380a
gacatatgaaaaaatactcatcatcactggtcatcagagaaatacaaatcaaatcacag
tgagataccatctcacgccagttagaatggcaatcattaaaatgtcaggaaacaacagat
gctggagaggatgtggagaaataggaacgcttttacactgttggtgggagtgtatattag
tccaaccattgtggaagagagtgtggcgattcctcaaggatctagaagaaataccatttg
acccagccatcccattacttgggtatatacccaaaggactataaatcatgctactataaa
gacacatgcacacatatgtttattgcggcgctattcacaatagcaaagacttggaactaa
cccaaaatgtccatcaatgatagactggattaagaaaatgtggcacatatacaccatggaa
tactatgcagccataaaaagggatgagttcatgtccttttgtagggacatggatgaagct
ggaaaccatcattctcagcaaactatcgcaaggacagaaaatcaaacactgcatgttctc
actcataggtgggagttgaacaatgagaacacatagacacagggagaggaacatcacact
ctggggcctatcatggggtgggggctggggagggatagcattagtaggagaaatacct
aatgtaaatgatgagttgatgggtgcagcaaacaaacatg >IGR3381a
aactatcgcaaggacagaaaatcaaacactgcatgttctcactcataggtgggagttgaa
caatgagaacacatagacacagggagaggaacatcacactctggggcctatcatggggtg
ggggctggggagggatagcattagtaggagaaatacctaatgtaaatgatgagttgat
gggtgcagcaaacaaacatggcacatgtatacctatgtaacaaacctgcatgttgtgcac
atgtaccctagaacttaaagtataataaaaaagaataaaaatataaataaagtagtc
ttggtgaaaaaacaaaacaaaacaaaaaaactttgcccagaccaaatgtctagaagtg
tttccccaatattttcttctcgtagtttcataatttggggtcttacattaaagtagttca
ttcattttgagttgatcttgcatgtggtgaaagagaggggtctagtttcgttattctgc
atgtggatattctgttttcccagtaccatttatttaagaggctattccttccccagtact
gttttggcatctttgttgaaaatcagttggctgtaaatatatgaatttatttctaggttc
ttgttgctgttctattttatgctagtaccatgctgggtttgtttagcttcttgaatctg
taatgtttatgtcttttaccaaatttgtgaaaattttggt >IGR3382a
cagtaccatttatttaagaggctattccttccccagtactgttttggcatctttgttgaa
aatcagttggctgtaaatatatgaatttatttctaggttcttgttgctgttctattttta
tgctagtaccatgctgggtttgtttagcttcttgaatctgtaatgtttatgtcttttacc
aaatttgtgaaaattttggtcattcttctctagttagtttttctaccacattcttgttt
ttctttttctgggattcctcttacacatatgtaagacctttcattgttgtctgatagttc
cctgaggctctgttaatttgtttctctcttctctcttcttcagattatataatatccatt
gtctactgctaatctcaatgattcttccctctgtcatctctatttcatgttaaccccat
ctattaaagttttaaattcagatactgtattttcagttctataattttttagttaattct TABLE 5-continued ttattgttgtttcttgttcttttctgaaacttgtcttcttttcactaactatgagtatta
ttttctttacgtcattgaacgtggctctaattaaccactctgaaatccttgtctgtgaa
ttccaacatctgtttcatctttgggttgatctctgtgtcttttctcttggaaataggtca
catgtttctggtccttcacatgtcaagcaactttctattg >IGR3383a
tttctgaaacttgtcttcttttcactaactatgagtattattttctttacgtcattgaa
cgtggctctaattaaccactctgaaatccttgtctgtgaattccaacatctgtttcatct
ttgggttgatctctgtgtcttttctcttggaaataggtcacatgtttctggtccttcaca
tgtcaagcaactttctattgtatcctggttgctactgagggaactccagattctgttata
ttcctttgaagaatgttgtcttgaactcctgacctcaagtgatccacccaccttggcttc
ccaaagtggtggaattacagacatgagccaccatgcctggccggaagaatgttgttgttg
ttaattaccaagcaattaacttggttggacacaaactgcaaactgttttttgtgcagtat
atttcttttattcctggctgggctacttgcagtataacctacatatgtgttgtttagcag
tctgccggagatttgggcagagtttacacacagatggagtgtctccatgctcctcttttt
actgggatttccttttactttcagaatttgtgcttgctccagactctgtaatctgata
ttttaggttaagaaaactgggttttctatcaaaattttagcagctgtatatgccatcaac
tatggtatgtcctgaggctaatagtcattttaaaaacagg >IGR3384a
agtttacacacagatggagtgtctccatgctcctcttttactgggatttccttttact
tttcagaatttgtgcttgctccagactctgtaatctgatattttaggttaagaaaactgg
gttttctatcaaaattttagcagctgtatatgccatcaactatggtatgtcctgaggcta
atagtcattttaaaaacaggaaatcaccctgtactgttctcttcattcaagggtcaactt
ccacccattatctgcctgcttttgtttactctccattgacttctactaattgtattttgt
atttttatccagagtttatagttgttatctgtgtgtgggtcactgtgatagaaaaatattc
aaccatattttcacatctttattttaataaaaataatttactcatagtaattttta
ttcttatgattgatatatttggtttcaatttgatgtattattccaggttaattttctgta
tttattattttatattttcctgttttactaggatatatcttggaattggccattctaggt
taactccattctttgattttcttctttcaaggattccaattataccatgttgctcttc
tttgcgattcttttatatttatcactatttctggccctgtttacctctgtgttcattttt
gcttcattttcttgacttttctcatcttcctctgtattgt >IGR3385a
tgttttactaggatatatcttggaattggccattctaggttaactccattctttgatttt
tcttctttcaaggattccaattataccatgttgctcttcttgcgattcttttatattt
atcactatttctggccctgtttacctctgtgttcattttgcttcatttctgacttttt
ctcatcttcctctgtattgttagtacagttttggtcatatctctttctttcttaggcac
attataatttagtatttgtttctacgattatttatcattttcttcaataacttcttga
gtttgatcagtttctatttacatcttttgttgtccatatccattccgagttttatatt
tctgatttttggcattctttcatatctacagttgtttgcttaattatatttaattaatct
tactgtatttgttatagttttctctttttttttggataggtcaggattgttttgttg
tgttttcaactcctgaaaaatttgattatatttatgttttctattatagtaactta
tgtggatgttgggtttaattttattttgttgttcctatgttatttgtgttggattttc
ctgaaccagtgatcttgagtcaactgttctttattctatagtgaaatgcagtttttt
caattaaaggtacttttatggtatgtcttcttcaaattgt >IGR3386a
ttttgattatatttatgtttttctatttatagtaacttatgtggatgttgggtttaatt
ttattttgttgttcctatgttatttgtgttggattttcctgaaccagtgatcttgagt
caactgttctttatttctatagtgaaatgcagtttttcaattaaaggtacttttatg
gtatgtcttcttcaaattgtttcttaatgtataattttaataggctcttactctcagcc
acttcattctcttcaccaccacacctccaaaggacagttcacttttcatggttcctcttt
caccccaggaacagtgccttccttatactatctctgtgtgcttttcaaagctcttgtgttt
aaaatatccataagccagtcctctgatgcactaagtctcagatgttctctctgtacttttt
ccactcagggtggagccctttcctctgaaagcaggaccttagatgatatatatgttaca
ccacattaaaagcacactgcatcatttactctttctgcagtcccagactggttctttgca
tagttgtcactggagtactctgctgacatttaatatttatttattcacttctaagaaaac
agaaatttgtactattctgtgtttcccggttacaacgtaggcataaataatgggtacttt
ttttctttgttggtggttttcagaaatttatgtagttaaa >IGR3387a
atcatttactctttctgcagtcccagactggttctttgcatagttgtcactggagtactc
tgctgacatttaatatttatttattcacttctaagaaaacagaaatttgtactattctgt
gtttcccggttacaacgtaggcataaataatgggtacttttttctttgttggtggtttt
cagaaatttatgtagttaaaattgcttttagaaggatgtctttttctatgacaccttgtt
acatttcaaataatcagtgtcactaaccagaacttttttcagctgtttgaatttgcttttc
ttttcagcaaatgacatatgctatgcatgaatgttaaaatagctgaaaagaattgcctgt
atttaaatattaaaagaattgcctgtatttaaatactaaaagaatcacctatatttaaag
aattgccttttatttgaataaaataaatatattgcctatgtttaaatgaaatagctgaaa
aattgcctatatttaaatatttaaatacataaatctactattttttagtattttaagtatttt
ttttatcaatactcatttagccccttactagatcatcccttgagagcagtgccttcttttgg
aaaatagtcaagggatggaagaggcaagcttatttgaaaaaacttgtatcacttctactgt
catactttataaaacatttatttagaacatctcaacagg >IGR3388a
ttaaatacataaatctactattttttatgttaagtatttttttatcaatactcatttag
ccccttactagatcatcccttgagagcagtgccttcttttggaaatagtcaagggatggaag
aggcaagcttatttgaaaaaacttgtatcacttctactgtcatactttataaaacatttt TABLE 5-continued atttagaacatctcaacaggggccaaaatgcctcatttctaactgccatacttcacacag
aaatataggcatacctcagagctattgcaggttcagttctcgaccaccataataaagtga
atatcacaataacaagagagcctgtccgttgaagccaggcattgacatctctctagctat
gaaagtcctagatggcaccttcttccaatggaagagtgtttcatctgcattgaaaatctg
ttgtttagtatagccaccttcatcagggatcttagctaggtcttctggatcacttactgt
agcttctaccttgcattcttgggattaaaaactttattcgatcatgatgtcttatctgtc
tgatgtattgatggattcaacttactaatgttttcttgcagattttaaaatctatgtac
atgaggtatattgctctttaattttcttttctatattgtctttctctggttttgttatc
agggcaatgctcacctcatgagttgggaactattccattc >IGR3389a
gggattaaaaactttattcgatcatgatgtcttatctgtctgatgtattgatggattcaa
cttactaatgttttcttgcagattttaaaatctatgtacatgaggtatattgctctttta
attttcttttctatattgtctttctctggttttgttatcagggcaatgctcacctcatg
agttgggaactattccattctcttctagtttccagaatagtttatatagaattgctagta
tttcttacttacttggtagaattcactaaatggacccatttgtgctggaattttcttgt
tggaatatactttaataagcatgggatcgttcatattatttcttcttgaatgagcttttg
gtagtttgtgtctttcaaggaatgtgtttgtttcatccaagttgttaaatatattaatgt
cagagaaatctgtgatagtccttcttgattcctgatataagcaatttgtttcttctttt
tttcaatatcagtttgactagaagcttctttaattgatcttttcaaggagttaacttta
aaaaattttcaataggttttttggggaacaggtggtgtttggttaaatgagtaagttctt
tagtggtgattttgagattttggtgcacttgtcacccaagcagtgtacactgtatccaa
tgtgtagccttttattcctcatcccttctcacttaccccc >IGR3390a
gaagcttctttaattgatcttttcaaggagttaacttttaaaaaaattttcaataggttt
ttggggaacaggtggtgtttggttaaatgagtaagttctttagtggtgattttgagatt
ttggtgcacttgtcacccaagcagtgtacactgtatccaatgtgtagccttttattcctc
atcccttctcacttaccccgaatccccaaagttcattgtattatatcattcttttgctt
tgcatccttatagcttagctcctacttatgagttagaacatacgatgtttggttttctat
tcctgatttacttcacttagaataatggtctccaattccatccaggttgctgagaatgcc
attattgtgttcatttttatgcctgagtagtattccatcatatgatttattttcatatg
tcttgtgctactataaatatgcatgtgcaagtatcttttttgtataatgacttcttttcc
tctgggtggatacccaagagtgggatttctggatcaaatggtagatctacgtttagttct
taaggaatctccacactgttttccatagtggttgtacttagttctttaaggaatctcca
cattgttttctatagtggttgtactagtttacattcccaccaacagtgtaaaagtgctcc
gttttcactgcatccacaccaacatctattatttttgat >IGR3391a
tgggatttctggatcaaatggtagatctacgtttagttctttaaggaatctccacactgt
tttccatagtggttgtacttagttctttaaggaatctccacattgttttctatagtggtt
gtactagtttacattcccaccaacagtgtaaaagtgctccgttttcactgcatccacacc
aacatctattatttttgatattttgattatggccattctttcaggagtgaggtggtatc
atatggtggttttgatttgcatttccttgatcattagtgatgttgagcattttttttaat
atgtctgttggccatttctgtaccttcttttgagaattgctattcatgtccttagtcca
ctttctgatgggattgttttgttcttgctaatttgtttgagttccttgtagattctggat
attagtcctttgttggatgtgtagattgtgaagattttctcccactctgtgggtgtctg
ttaactctgctgattatttcttttgcagtggagaagcttttttagttaagtcccatctgtt
tatctttttttttttgtttgtttgtttgcttttgggttcttggtcatgaagttttgcctt
ctagtcagtgtctagaaggatttttttcaatgttatcatctagaatctttatggtttcagg
tcttggatttaagcctttgatccatcttgttgattttgt >IGR3392a
ttttgcagtggagaagcttttttagttaagtcccatctgtttatctttttttttttgtttgt
ttgtttgcttttgggttcttggtcatgaagttttgcctttctagtcagtgtctagaagga
ttttttcaatgttatcatctagaatctttatggtttcaggtcttggatttaagcctttga
tccatcttgttgattttgtataaggtgagagatgaggatctggtttcattcttctacat
gtggcttgtcagttatctcagcaccatttgttgaatagggtgtccttctccaccttata
tttttgtttgctttgtcgaagatcagttggctgtaagtatttgtctttatttctggattc
tgcaatctgttccattggtctatgtgcctgtttttatactaaataccaagctgttttggt
gattatggccttatagtatagtttgaagtcagataatgtgatgcctccagattgttcttt
ttgcttagtcttgctttggctgtgaggctcttttttggtttcatatgaattttaggatt
gttttttctagttctgtgaagaatgatgatgtattttaatgggaattgcattgactttg
tagattgcttttggtggtatggtcattttcacaatgttgattctacccatccatgagcat
gggatctgtttccatttgtttgtgccatctatgatttctt >IGR3393a
tgtggaggctcttttttggtttcatatgaattttaggattgtttttttctagttctgtgaa
gaatgatgatggtattttaatgggaattgcattgactttgtagattgcttttggtggtat
ggtcattttcacaatgttgattctacccatccatgagcatgggatctgtttccatttgtt
tgtgccatctatgatttcttcagcagtgttttatagtttctccttgtagaggctttcac
ctttcaaggagttaacctttgtttcacagattttctctattgtgtctcttttgtcatatt
tcattgatttctgcccttctacataaattttttccttctacttgctttgcgtttaatttg
ttgttctttttctaggctcttagagtagcaggttaggttattgactggaaacttttcata
aaaacatttaatctacattttcttgtaagcattgttttgactatattgtgccaaaat
ttgaaaaaaaaattcttatattgggataaattttagatttatgtaatagttttaaataga
atatagagttctctcatatatttcatcatttcctctaatgttaataacttacataaccat
ggtacattttcaaaactgaaaaattaacattgatatattactattaccttaagatccag
actttattcagatttaaccaacttttctactaatgtcctt TABLE 5-continued >IGR3394a
ttgggataaattttagatttatgtaatagtttaaatagaatatagagttctctcatata
tttcatcattccctctaatgttaataacttacataaccatggtacattttcaaaactga
aaaattaacattgatatattactattaccttaagatccagacttattcagatttaacca
acttttctactaatgccttttttgttctaggatccaacccaaaataccacagtgcatc
tagtcatcatgtctctttcatttattctttccttattttaaagaccttgatggttatta
agagtcatatgttatagaagggccaccaacttagattttctgatgtttcttatgat
tacaccaaagttatcaatttgagggaagaatgtaccttcatgttgcataatttagggg
aacgtgactgatgaagtaaactttgatcacttggccaaggtcatcacacaagtatgatat
gttgtccctacatgtaaatgcaactcagaatgtttctaatttccttatgacttccact
ttgactcatgagttattagaagcatgttgcttatttcacaaatatttggggattttcca
gatatttctgttattctaattttattctgttgtggtcagataacatactttgtgtgctttt
cagttatttaaatttgttgaggattgttttatgaccaag >IGR3395a
caactcagaatgttttctaatttccttatgacttccactttgactcatgagttatttag
aagcatgttgcttatttcacaaatatttggggattttccagatatttctgttattctaat
tttattctgttgtggtcagataacatactttgtgtgctttcagttattttaaatttgttg
aggattgttttatgaccaagaatatgatttagcttgatgaatgttcatgtgcacttgaa
aagaatgtgtattctgctgttgtttagttgaatgctctttaaatgtcaactaggtaaagt
tggttgatagtgttgttcaggtcttctgtatccttatttatttttctctatttttttcta
tcatttattgaggactgttgaggtgtaactgtaattgtgggtttgtatgtttctattcag
gtctatcattttgcttcatgtattttgaaactcttggttaggtaagtacataattagga
ttgttatgtattcttggttaatttaccacttttgtcatcctataatgtccctgttttcata
tatgaaaacagggacaagaaatattttatatatatatataaatttatatatatata
aaatatttcttgttctgaagtctcctttttgatactaatatagctgttctagctttctt
ttgatttatgtttcaacaatatatcattttccatcattt >IGR3396a
atttaccactttgtcatcctataatgtccctgttttcatatatatgaaaacagggacaag
aaatattttatatatatatataaatttatatatatatataaaatatttcttgttctgaag
tctcctttttgatactaatatagctgttcagctttcttttgatttatgtttcaacaat
atatcattttccatcattttattttattaaattaatgcacttcatttttaaaagaagtt
ttaggtttacaaaaaacttagcataaagtacagtgcttctataatcccctaccccccatat
agtttctcctattattaacttcttgctttcacgtggtgtgttcattacaagtgatgcaca
aatatgatacattattattattattattttgaggcagagtctctccctctgtcacccag
gctggagtgcagtggcatgatctcgatctcggctcactgaaacctccgcctcctgagttc
aagctattcttctgcctcagcctcccgagtagctggatctacaggcatgcaccaccatgc
ccggtaatttttcatttagtagagacggggtttcaccatgttggccaggctggtct
caaagtgcggggattacaggcatgagccacagcccagcctgatacattattattaact
aaagtccacaattcacattagagttctctctttgtgttgt >IGR3397a
cctcccgagtagctggatctacaggcatgcaccaccatgcccggctaatttttcatttt
tagtagagacggggtttcaccatgttggccaggctggtctcaaagtgcggggattacagg
catgagccacagcacccagcctgatacattattattaactaaagtccacaattcacatta
gagttctctctttgtgttgtacagttctgtagattttgacaattgtatgacatgtgtcca
ccgttacagttttatacagcataatttcattgccaaaaaaatgttctgtgctccacttat
tcatcattccctctgcccgcaaactcttggcaaccactggtcttttctaccatctgtatag
ttttgccttttccagaatgtgatgtaaatttgagtcatacattatttagccttctcagatt
ggtttctttcacttagcaacatgcatttaaggtttccccctgtctttttgtggcttgata
gctcatttccttatattgccaaataatattttattgtatggctgtatcagtttgtttatc
cattcatctattggaggatgtcttggttgtatccaggttttggcaattatgaataaagct
actgtgaacatttgtatgcaggtgtttgggtgtacttggattttcaactgatttgggtaa
ataccaagcagcatgatcgctggattgtatagtaagacta >IGR3398a
aaataatattttattgtatggctgtatcagtttgtttatccattcatctattggaggatg
tcttggttgtatccaggttttggcaattatgaataaagctactgtgaacatttgtatgca
ggtgtttgggtgtacttggattttcaactgatttgggtaaataccaagcagcatgatcgc
tggattgtatagtaagactatgtttagctttgtaagaaactgctgaactctcttccaaaa
tggctatagcattttgcattcctaccaacagtgtataagagtttctatagctatatatcc
tcaccaatatttggtgttgcctgtgttttggattttcatcattctgacagatgcatagtg
atatctcattggtgttttaatttgcaattccctaatgacatataatatttagcgttttt
tcccccccgagatggagtctggctctgttgcccaggctggagtgcagtggtgcggtctcag
cccattgcaacctctgcctctcgagttcaagcaattctcctgcctcagcctcccaagcag
ctgggattacaggcgcctgccaccatgcatggctaatttttgtattttagtagagaagg
ggtttcaccatgttgaccagactggtctccaactcctgacctcgtgatctgcctgcctca
gcctcccaaactgctgggattacaggtgtgagccaccacg >IGR3399a
tcgagttcaagcaattctcctgcctcagcctcccaagcagctgggattacaggcgcctgc
caccatgcatggctaatttttgtattttagtagagaaggggtttcaccatgttgaccag
actggtctccaactcctgacctcgtgatctgcctgcctcagcctcccaaactgctgggat
tacaggtgtgagccaccacgcctggccaatatttagcatcttttcatatacttacttgcc
atttgtatatcatctttgatgaggtgtgtttgttagatatttttgcccattttaaagt
tgggttatttatttcttattgttgagttttgagagttctttatatattttaataacag
tcctttatcagatacgtgttttgcaaatattttctcccagtctgtggcttttcttttat TABLE 5-continued tctcttgacatattttacttttaacccatctttgcctttatgtttagagtgagctcctta
tagaaagcatataatcatgccttgcttttcatccaattggacaatctcttttaatattg
tatgtttagatcatttatacttaatatagttattgatatagttggactaaaatctgtcat
ttttcttgctattttttatttgttccatctgttttttgttctttttttccccttttctgc
ctgcttttgaattggctattttcttttattatactttaag \>IGR3400a
cttgcttttcatccaattggacaatctcttttaatattgtatgtttagatcatttatac
ttaatatagttattgatatagttggactaaaatctgtcattttcttgctattttttatt
tgttccatctgttttttgttctttttttccccttttctgcctgcttttgaattggctatt
ttcttttattatactttaagtttagggtacatgtgcacaatgtgcaggtttgttacata
tgtatacatgtgccatgttggtgtgctgcccccattaactcgtcatttacattaggtata
tctcctaatgctatccctcccctctcccctacccgacaacaggccctggtgtgtgatgt
tccccttcctctgtccatgcgttctcattgttcaattcccacctacgagtgagaacatgc
ggtgtttggattttttgtccttgtgatagtttgctgagaatgatggtttccagcttcatc
catgtccctacaaaggacatgaactcatcattttttatgcctgcatagcattccatggtg
tatatgtgccacattttcttaatccagtctatcattgttggactattttttatgctgttt
ttttccttcctttattggcttatttataacctcttttaagaaaattttagtggttgtcct
taagtttacagtatgcacctttaattaatcacagtcagcc \>IGR3401a
gaactcatcattttttatggctgcatagcattccatggtgtatatgtgccacattttctt
aatccagtctatcattgttggactattttttatgctgttttttttccttcctttattggct
tatttataacctcttttaagaaaattttagtggttgtccttaagtttacagtatgcacct
ttaattaatcacagtcagccttcaaatagtacgtataatatataaggtttaagaacct
tatgatactcctaattttttcctcccaattttttgtgctatagttttcatgcactttattat
atgctgtattccaacacactgctactattttttgctttagacaattatgttttagataat
taaaaataagaaaaagtattttatgtttatcttcatttatccattcccagacatcttat
tactttgtgtagattcaagttcttgtagggcaggtctgtggataatgaattatctcagct
tttatttgtctgaaaagatatttaggaatttgagtttccagtccagcatgttaggagttt
taaaaagttgccactccatcctaacaacaaataaaaactgaacaagctgaagaattaaca
actcttcttagatctataagagaggtgaggtcacaaggtaaacttctgccccagaattg
gggagaaaaacaggcagatacagaaaatcacaacttacca \>IGR3402a
tttaggaatttgagtttccagtccagcatgttaggagttttaaaaagttgccactccatc
ctaacaacaaataaaaactgaacaagctgaagaattaacaactcttcttagatctataag
agaggtgaggtcacaaggtaaacttctgccccagaattggggagaaaaacaggcagata
cagaaaatcacaacttaccagagcggaaactcacctccatgagaagaagtaccgggatag
aaaaacctgaactatagttgacaaattgtggaggctcagtgtggacaagcctgagtaata
aaaaccccaggggatcccagtcatcaggtatccctcacacttctgtaagttttatgtgaa
gattggagaaaaatctccttatgcttccagcaggggagggaaaaaggaacgttttttgtaa
tatgtcaagagcattctgttcttgaccagacctgagcctaacctgctgaagttttgttta
agagctcgacccatctgggcaagggaaataactccagcccctctggctatcctttccc
atttaaaggggggataaaaagctgaaaacgactggtgaagttcattgtctagcaacacag
gctcaccagaagactgagatctaatcataggactatggaacacttccctgccctccatat
cttaccactacattactaaaagcctatgtagccaggcgcg \>IGR3403a
caagggaaataactccagcccctctggctatcctttccatttaaaggggggataaaaa
gctgaaaacgactggtgaagttcattgtctagcaacacaggctcaccagaagactgagat
ctaatcataggactatggaacacttccctgccctccatatcttaccactacattactaaa
agcctatgtagccaggcgcggcgtctcacgcctataatcccagcactttgggaggccaag
gcgggagaatccttgaggccaggagttcaagaccatcctggctaacatggtgaaacccc
atctctactaaaattacaaaaaatagctgggcttggtggcacacacctgtaatcccagct
acgtgggaggctgaggcaggagaaccacttgaacccgggaggcagaggttgcagtgagct
gagatcacgccactgcactccagcctgggcaacaaagtgcgactctgtctcaaaaacaaa
caaataaacacacaacctaaaagtcttttaccacaattcctttaccccgtacacccttt
cagcagtatactacaaggcatattaaaaggcaaaaaacacaattggaagagacagagcaa
ccatcagaatcagacccatatgtggcaaggatgtgagaattatcagactgggaattttaa
acaactatgattaatatgccaagggcactaatagaaaaag \>IGR3404a
aagtcttttaccacaattccttttaccccgtacacccttcagcagtatactacaaggca
tattaaaaggcaaaaaacacaattggaagagacagagcaaccatcagaatcagacccata
tgtggcaaggatgtgagaattatcagactgggaattttaaacaactatgattaatatgcc
aagggcactaatagaaaaagtaggtaacatgcaagaacagatgagtaatgtaagcagaga
aatgcaaactctaagaaagatttaaatcaatgaagatgctggaaataaaaacatagtaa
ctgaaattaagaatacctttggttaagctcatcagtatactggacacagatgaggaaaga
aacagtgagacttaagatatgtcaatagaaatttcccaaaatgaaaggcaaagaggaaat
aaaactttaaaaaacagaatatccaagaactgtaagacaaccacaaaaatgtaagtacat
ataatgatagtattggagaagaaactgagaaggaacagaagcaatatttgaagcagtaa
ggaaataattttcctcaaattaatgtcagacatcaaaccacagatctaagaatcagagaa
caccaaataggataaaattttaaaaagcccccaaaaatgaaaaactatacctaggcatatc
atattaaaactgcagaaattttcagataaagaaaaaaaat \>IGR3405a
gaaactgagaaaggaacagaagcaatatttgaagcagtaaggaaataattttcctcaaat
taatgtcagacatcaaaccacagatctaagaatcagagaacaccaaataggataaaattt TABLE 5-continued taaaaagccccaaaaatgaaaaactatacctaggcatatcatattaaaactgcagaaatt
ttcagataaagaaaaaaatcttgaaagaaagccgggggtggaggggggaatcttatcta
taaaggagcaaagataagaaatatttctcctcctgagaaatcatgcaagcaagaaaaat
tggagtgaaaaatcaaagcattgagagaaaaaaaaaaaaccccaccaacctacaattctg
tccctgcaaaattatccttcaaaagtgaagatgagataaagactttctcagataaacaaa
aactgaatgaaattgttgccagtagatcttccttgtaagaaatgtttaaaagaagttgtt
cagggagaaggaaaatgatataggtcagaatctcagatctatataaagaaagcatcagag
aaggagtaagtaaatataaaataaacacatttttcttattcttaattgatgtaactgata
acagtttgtttaacaatattaacaatgcattcaattttgtgtgtgtatataaatatatac
atttatgtgtgcttatgaataagtgaaatgaatgacagca IGR3406a
taggtcagaatctcagatctatataaagaaagcatcagagaaggagtaagtaaatataaa
ataaacacatttttcttattcttaattgatgtaactgataacagtttgtttaacaatatt
aacaatgcattcaattttgtgtgtgtatataaatatatacatttatgtgtgcttatgaat
aagtgaaatgaatgacagcagtgatgcaagggatgggaggggagaattagaaatacttggt
tattaggtacttgcactgtatgggaagtggtatagtattatttgaaaaatggattgggggt
tagttatataaatgcatatttcaaactctagggcaaccacttaaaaagtaagaaaaagaag
tataattggtatgctaagaaaagagagaaaatggaatcatataaaatgctcaattaaaac
cacggaaggcagaaaaagagtggaagacagaaataggaacaaagaacaaaggcaacaaat
agaaaaaatagtaacagatatggcagatcaaactatatcagtaaacacttcacagtcact
ctggaaggcagtttggctgtctcttaccaaactaaacatgctcttagcacatgatccagc
ccttgcactccttagaatttacccaaataagttaaaaacttatgttcacccagaacagct
gcatacagctgtttatagcagctttcttcatagttgcgaaaac >IGR3407a
cagatcaaactatatcagtaaacacttcacagtcactctggaaggcagtttggctgtctc
ttaccaaactaaacatgctcttagcacatgatccagcccttgcactccttagaatttacc
caaataagttaaaaacttatgttcacccagaacagctgcatacagctgtttatagcagct
ttcttcatagttgcgaaaacctggaagcaaccaagatgtcttgcttccaggtttggaagg
atggatgggtaaataaactgatacatccaggcaatgaaatattgttcagtgctaaaagga
aatgcactatcaagctataaaaagacatggaggaaccttaaatgcatattgctaagtgaa
agaagctcatctgagaaggccagcttcaagtgattctcatgcctcaacctctcaagtagc
tgggattacaggcacgtgccaccatgcctggctaatttttcatttttagtagagacaag
gtttcaccatgttggccatgctggtcttgaactcttgacctcaagtgatccgcccacctt
ggcctcccaaagtggtaggattacaggcatgagccaccatgcccacccccattatacgtt
tgtcaaaacccacagaatgtacgccaccaagagtgaaccctaatataaactgtggacctg
gggtgataattatgtgacaatgtaggttcattgatctaac >IGR3408a
ctggtcttgaactcttgacctcaagtgatccgcccaccttggcctcccaaagtggtagga
ttacaggcatgagccaccatgcccacccccattatacgtttgtcaaaacccacagaatgt
acgccaccaagagtgaaccctaatataaactgtggacctggggtgataattatgtgacaa
tgtaggttcattgatctaacacatgtaccactgtgacgcagtacatcaatagtggggaat
gtttatgcatgtgtaggggcatggatagatgaggagtctgtacttcctgcttaattttgc
tgtgaacctaaaactgctgttttttaaaagattttttcccccttcagttaaaagattattt
cacttggtgtagaattctgggttgatagcaattttttttcttttattcctttaaagatct
cacaccattgtcttctggattatataatttctgaatatgtctgctgtaattcttatcttg
tttatctgtgtgtaatgtttcttttttatcttgtcatgtttaagattttctatttgttttt
ggttttcagcagtttaaatataacgtatctttctaagcgtgatttcttttagtggtggtg
gtgggggtatttatcctgattgtgacctctgagtttatttttttaaaaaatacatatatat
atttaatatatatttaaatgtatatttttttatatatttat >IGR3409a
cttttttatcttgtcatgtttaagattttctatttgttttggttttcagcagtttaaata
taacgtatctttctaagcgtgatttcttttagtggtggtggtggggtatttatcctgatt
gtgacctctgagttttatttttttaaaaaatacatatatatatttaatatatatttaaatg
tatattttttatatatttatttattttagagacagggtcttgctgtgttgtccagactgg
tgttgaactcctggtttcaagcgatcctcccacctgggattacaggcatgagccactatg
cccaatcatctctctgagcttcttggatctgtagtttgtatctttcattattttctgaag
attcttggctaattctctcttaaatatttcttcttttaaaaaatatctacttcaaatacct
aatatagatgacgggttgatgggtgcagcaaaccatcatggcatgtgtataccctatgtaa
caaacctgcacgttctgcacatgtatcccagaacttaaagtataataaaaaaaatttta
aaagaaaaattaaaatctacttccttcctctggaattttaaggcttaggagaagagttg
tgtacatgtccagaagaaagtggagttgagtcagtttattaggatgtggtgtgggtttg
ggattttttgtttttgttttgtggttgctttcagtgta >IGR3410a
atgtatcccagaacttaaagtataataaaaaaaattttaaaagaaaaattaaaatctca
cttccttcctctggaattttaaggcttaggagaagagttgtgtacatgtccagaagaaaa
gtggagttgagtcagtttattaggatgtggtgtgggtttgggattttttgttttgttt
ttgtggttgctttcagtgtacctccaacttcaaagcattgtgcttagagtagaggctggg
tttccagaggttttttgttttgttttcttaaaatgttcctgcttacttgcagctttcag
aattcccagtggacctgtaccttgagggatgtttcttgatgcatgcttgccccttgtcc
agcagtggtctcctgttccttgttactcatgcttgctagtccagtgatgggaccagtga
ggactctctactgtcctggtccagcctcactattagacaggctaaaagttctgtcagcct
gtgggaagggcaggaaatggtctggcccaagttcattagaggttttttgttattggtttgt TABLE 5-continued ttgtttgtttgtttgtttgttttgagacagagtcttgttctgtcacccaggctggagtgc
agtggtgcgatctcagctcactgcaacttctgcctcctgggttcaagcaattctcctgcc
tcagctcctgagtagagggattacaggcatgtgccacta >IGR3411a
tctggcccaagttcattagaggttttgttattggtttgtttgtttgtttgtttgtttgt
tttgagacagagtcttgttctgtcacccaggctggagtgcagtggtgcgatctcagctca
ctgcaacttctgcctcctgggttcaagcaattctcctgcctcctgagtagagggg
attacaggcatgtgccactatgcccaactaattttttgtattttttagtagagaaggggttt
tgccatgttggccaggcttgtctcaaactcctgacctcaagtgatccacccacttcagcc
tcccaaagtgttgagattacaggtgtgagctatcgcacctggccatgaggtgttctacca
ctgttggaagggtagaatgttcttttccaggtcaagatccatcaaagaaacaaggaaaagt
ttggctgtctcagagagggggatcaggatcaccaggaaatctccagacatggagaaccagt
ctttcttgtgagcatccagtaaaggtctgtggagaaaaatgtatgagagaggtgtgaatt
tttcttgtgtctgtgactcccaggaatttcatattcacacattagcccacaatttgcctt
tagtaattttttttttaaaagctccagtctgcagctcccagtgagaccaacgcagaagg
tgggtgatttccagctgaggtgcccggttcatctcattgg >IGR3412a
aaaggtctgtggagaaaaatgtatgagagaggtgtgaattttcttgtgtctgtgactcc
caggaatttcatattcacacattagcccacaatttgcctttagtaattttttttttttaaa
agctccagtctgcagctcccagtgagaccaacgcagaaggtgggtgatttccagctgagg
tgcccggttcatctcattgggactagttaggcagtgggtgccacccacagagagcaagca
gaagcagggtggggcatcgcttcacctgggaagtgcaaggagccaggggacctcccttcc
acagccaagggaagtggtgagggactgtgctaccctccctggatactacactttcccgt
ggatttttgcaatctgcagatcaggagattccctcgtgaacttacaccaccagagccctg
ggtttcaagcacaaaactgagcagctgattgggcaggcactgagctagctacaggagttt
ttttgtactccagcggcacctggaaccataatgagacaggagacaggagagacaggagaa
ccgtccactcccctagaaagggggcttgaagccagggagccaagtggtcttgctcagcagg
tcccactcccacagatcccagcaagctaagaaccactggcttgaaattctcactgccagc
acagcagtctggagttgacccagaatgatcgagcttggtg >IGR3413a
tggaaccataatgagacaggagacaggagagacaggagaaccgtccactcccctagaaag
ggggctgaagccagggagccaagtggtcttgctcagcaggtcccactcccacagatccca
gcaagctaagaaccactggcttgaaattctcactgccagcacagcagtctggagttgacc
cagaatgatcgagcttggtggcgggaggggcatccaccagtactgaggcattagtaggcg
gttttcccctgacagtgctaaggagactgggaggtttggaatgggcagaatttaccacag
catggcaaagtgactgtggccagattgcttctctagattcctcctcactgggcagggcat
ctctgaaggaaaatcagcagctccagtcaggggcttacagataaaactctcatcttcctg
gtacagagcatctggagggaagggcagctgcagtcacaacttcagcagacttatatctt
cctgcctcctggctctgaagaaagcaactgatcctgacaaggggggattattccagcacag
tgtactagctctgctaaggaacagactgccttctcaagtgggtccctgacccctgtgcct
ctgactgggagagacctcccaacagggatcaacagacacctcatacaggagagctctggc
tggcatcaggccagtgcccctgggatgaagcttccagag >IGR3414a
aaagcaactgatcctgacaaggggggattattccagcacagtgtactagctctgctaagga
acagactgccttctcaagtgggtccctgacccctgtgcctctgactgggagagacctccc
aacagggatcaacagacacctcatacaggagagctctggctggcatcaggccagtgcccc
ctgggatgaagcttccagaggaaggagcaggcagcaatctttgctgttctgcagcctcca
ctggtgatacccaggtgaacagggtctggagttgacctccagcaaactacagcagacctg
cagaagaggggcctgactgttagaaggaaaactaacaaacagaaagcagcaacaacaaca
acataaaaaagatccccacacaagaaccccatccaaaggtcattagcctcaaagatcaaa
ggtagataaatccatgaagatgaggaaaaaccagtacagaaatgctgaaaattccaaaag
ccagaatgcctcttctcctccaactgattgcagcacctctccagcaagggtgtaaaactg
gacagagaatgagattgatgaattgacagaagtaggcttcagaagatgggtaataacaaa
ttcctctgagctaaaggagcacgttctcacccaatgcaaggaagctaagaacctaataaa
aggttacaggaactactaactagaataaccagttcagaga >IGR3415a
caactgattgcagcacctctccagcaagggtgtaaaactggacagagaatgagattgatg
aattgacagaagtaggcttcagaagatgggtaataacaaattcctctgagctaaaggagc
acgttctcacccaatgcaaggaagctaagaacctaataaaaggttacaggaactactaac
tagaataaccagttcagagaggaatataaatgacctgatgtagctgaaaaaacagcatga
taatttagtgaagcataaacaagtattagtagccaaatcacgtggaagaaaggatgtcag
aaattgaagaccaccttgctgaaataaagcatgaagacaagattagagaaaaaggaatga
aaaggaatgaacaaagcctccacaaaatatgtgactatgtgaaaggaccaaacctacaat
taatgggtgtacctgaaagtgatgggagattggaaccaagttggaaaacacacttcagg
atattatccagaacttccccaacctagcaagataggccaatattcaaattcaggaaatac
agagaacaccacaaaaatactccttgagaagatcagcccccaagacacataatcttcagat
tcaccaaggttgaaatgaaggaaaaaatgttaagggcagccagaaagaaaggtcgggtca
cgtacaaagggaagcccatcagactaacagcagatctctc >IGR3416a
aacctagcaagataggccaatattcaaattcaggaaatacagagaacaccacaaaaatac
tccttgagaagatcagcccccaagacacataatcttcagattcaccaaggttgaaatgaag
gaaaaaatgttaagggcagccagaaagaaaggtcgggtcacgtacaaagggaagcccatc
agactaacagcagatctctctgcaaaaaccctacaagccagaagagcatgggagccaata TABLE 5-continued ttcaacattcttaaagaaaagaattttcaacccagaattttatatccagccaaactaagt
ttcataagcaaaagagaaataaagtccttgagagacaagcaaatactgaggattttgtca
ccaccaggcctgccttgcaagagcacctgaaggaaacactaactatggaaaggaaaaact
ggtaccagccattgcaaaaacacatcaaaatataaagaccatcaacactatgaagaaact
gcatcaactaatgtgcaaaatagccagctagcatcatgatgacaggatcagattcacaca
caataatattaaccttaaatgtaaatgggctaaatgccccagttaaaagacacagactgg
caaattggataaagagtaaagacccatccatgtgctgtattcagtagacccatctcatgt
gcaaagacacacataggctcaaaataaagggatggaggga >IGR3417a
tagccagctagcatcatgatgacaggatcagattcacacacaataatattaaccttaaat
gtaatgggctaaatgccccagttaaaagacacagactggcaaattggataaagagtaaa
gacccatccatgtgctgtattcagtagacccatctcatgtgcaaagacacacataggctc
aaaataaagggatggagggatatttaccaagcaaatggaaagcaaaaaagtaggagttg
cagtcctagtctccgataacacatactttaaaccaacaaagatcataaaagacaagagg
ggcattacataatggtaaagggatcaatgcaacaagaagagctaactctcctaaatgtac
atgcacccaatacaggagcacccagattcataaaacaagttcttagagatgtacaaagag
acttagactcccacacaataaaaaagggagactttaacaccccactttcaatattagatg
gatcaacgagacaagaaaattaacaaggatattcaggatgtgaactcagctctggatcaa
ggggacctaatagacatctacagaactctccaccccaaatcaacagaatatttattcttc
tcagcaccacatggcacttattctaaaattgaccacatgattgggagtaaaacactcctc
agcaaatgcagaagaatggaaataataacagtctgtcagac >IGR3418a
aacaaggatattcaggatgtgaactcagctctggatcaaggggacctaatagacatctac
agaactctccaccccaaatcaacagaatatttattcttctcagcaccacatggcacttat
tctaaaattgaccacatgattgggagtaaaacactcctcagcaaatgcagaagaatggaa
ataataacagtctgtcagaccacagtgtgattagcattaagaagctcactcaaaacctca
caactacatggaaattgaacaatgtgctcctgaatgactactgggtaaataacaaaatta
aggcagaaatcaagaagttctttgaaaccaatgagaacaaagactcaacatgccagaatc
tctgggacatagctaaagtagtgttaagagagaaatttatagcactaaaggcccacatca
gaaagctggaaagatctcaaattgacaccctaacatcacaattaaaaggattagaaagca
ggagcaaacaaattcaaaaactagcagaagacaagaaataactaagattagatcagaact
gaaggagatagaggcacaaaaaacccttcaaaaatcagtgaatccaggaggtggttttttt
gaaaaaaaaaaaaaattaacaaaatagatagactcctagctagactagtaaagaagaaa
agagaagaatcaaatagacacaataaaaatgataaagaga >IGR3419a
ctagcagaagacaagaaataactaagattagatcagaactgaaggagatagaggcacaaa
aaaccccttcaaaaatcagtgaatccaggaggtggttttttgaaaaaaaaaaaaaaattaa
caaaatagatagactcctagctagactagtaaagaagaaaagagaagaatcaaatagaca
caataaaaatgataaagagaatatcagcactgatcccacagaaatgcacactaccatcag
agaatactataaacacatctacacaagtaaactagaaaatctagaaaaaatggataaatt
cctggacacatacatcctcccaagactaaaccaggaagaagtcgagtccctgaatagacc
aataacaagttctgaaatcgaggcaataattaatagcctaaccaaaaaaaaatcccagg
accagacagatttcacaaccaatttctaccagaggtacaaagaggagctggtaccattcc
ttctgaaactattctaaataattgaaaaagaggcactcctcctgaactcattttatgagg
ccagcatcatcctaataccaaaaccttgcagagacataacaaaaacagaaaacttcaggc
caatatccctgatgaacattgatgagaaaatcctcaataaaatactggcaaaccaaatct
agcagcacatcaaaaaagttatccaccacaatcaagtcag >IGR3420a
attgaaaaagaggcactcctcctgaactcattttatgaggccagcatcatcctaatacca
aaaccttgcagagacataacaaaaacagaaaacttcaggccaatatccctgatgaacatt
gatgagaaaatcctcaataaaatactggcaaaccaaatctagcagcacatcaaaaaagtt
atccaccacaatcaagtcagcttcatccctgggatgcatggctggttcaacatatgcaaa
tcaataagcgtaatccatcacataaacagaaccaatgacaaaaactgcatgattttctca
atggatgcagaaaacgccttcaataaaattcaacatcccttcatgctaaaaactctcaat
aaactaggtattcatgaacatatctcaaaataataagagctatttatgacaaacccaca
gccaatatcactactgaatgggcaaaagctggaagcattctctttgaaaacccagcacgag
acaaggatgccctctcttaccactcctattcaacatagtattggaagttctggccagggc
aatcaggcaaaagaaagaaataaagggttcaaataggaagagaggaagtcaaattgtctc
tgtttacagatgacatgattctatatttagaaaacccctattgtcttgcccaaaatctctc
taagctgataagcaaatttagcaaagtctcagggtacaaa >IGR3421a
cactcctattcaacatagtattggaagttctggccagggcaatcaggcaaaagaaagaaa
taaagggttcaaataggaagagaggaagtcaaattgtctctgtttacagatgacatgatt
ctatatttagaaaacccctattgtcttgcccaaaatctctctaagctgataagcaaattta
gcaaagtctcagggtacaaaaccaatgtgcaaaaattacaagcattcctatacaccaaca
atagacaagcagagagccgaatcatgaatgaactctcttttcacaattgctacaaagatag
taaaatacctaggaatacaacttacaagggatgtgaaggacctcttcaaggagaacaaca
aacaactgctcaaagaaataagagaggacacaaacaaatggaaaaacattccatgctcat
ggatagaaagaatcaatattgtgaaaattgccatactgcccaaagtaatttatagattca
atgctgttcccatcaagctaccattgactttcttttgcagaattaaaaaaactactttgaa
tttcatatggaacctaaaaagaacctgtatagccaagacctaagcaaaacaacaaagct
ggaggcatcacgctccctgacatcaaactatactacaaggctacagtaagcaaaacagca
tggtactgctaccaaaacagatatatagaccaatggacca TABLE 5-continued >IGR3422a
ccattgactttctttgcagaattaaaaaaactactttgaatttcatatggaacctaaaaa
gaacctgtatagccaagacctaagcaaaaacaacaaagctggaggcatcacgctccctga
catcaaactatactacaaggctacagtaagcaaaacagcatggtactgctaccaaaacag
atatatagaccaatggaccagaacagagacctcagaagtaacaccacacatctacaacca
tctgatctttgacaaacctgacaaaagcaatggggaaaggattccctatttaataaatga
tgctgggaaaactggctaaccatatgcagaaaactgaaacttccttatacctttatacaaa
aattaactcaagatggattaaagacttaaatggaaaacccaaaaccataaaaaccctaga
agaaaaacctaggcaataccattcagaacataggcatggacaaagacttcatgattaaaa
caccaaaagcaatggcaacaaaagccaaaatagacaaatgggatctaattaaactaaaga
gcttctgcacagcaaaagaaactatcatcagagtgaacaggcaaccgacagaatgggaga
aaattttttgcagtctacccatctgacaaaggtctagtatccagtatctacaaggaactta
aacaaatttacaagaaaaatcaaatgaccccgtgaaaaag >IGR3423a
aaagccaaaatagacaaatgggatctaattaaactaaagagcttctgcacagcaaaagaa
actatcatcagagtgaacaggcaaccgacagaatgggagaaaattttttgcagtctaccca
tctgacaaaggtctagtatccagtatctacaaggaacttaaacaaatttacaagaaaaat
caaatgaccccgtgaaaaagtgggcaaagtgtatgaacagaaaattctcaaaaaagacat
ttatgtggccaacaaacatatggaaaaaggctcatcatcccaccattagagaaatgcaaa
tcaaaaccacagtgagataccatctcatgtaagtcagaatggtgattattaaaagtcagg
aaacagtagatggtgacgaggctgtggagaaataggaatgcttttacagtgttggtggga
gtgtaaattagttcaaccattgtggaagacaatgtggcgatacctcaaggttctagaatc
agaactaccatttgacccagcaatcccattactgggtatatacctaaaggattagaaatc
attctataaagacacatgtgcatgtatgtttattgcagcactatttacaatagcaaagac
ttggaaccaacccaaatgtccatcaatgctagactggatatacaccatgaatactacgc
aaccataaaaaagaatgagatcgtctcctttgcaggtaca >IGR3424a
caatcccattactgggtatatacctaaaggattagaaatcattctataaagacacatgtg
catgtatgtttattgcagcactatttacaatagcaaagacttggaaccaacccaaatgtc
catcaatgctagactggatatacaccatgaatactacgcaaccataaaaaagaatgaga
tcgtctcctttgcaggtacatggatgaagctggaagccatcattctcagcaaactaacac
aggaacagaaaaccaaacactgcatgttctcactcataagtgggagttgaacaatgagaa
cacatggacacaggaaggagaacaacacacgtcaaggtctgttaggggtgggggcaag
gagagggagagcattaggacagatacctaacgtaagcagggcttaaaacctagtgacgg
gttgataggtgcagcaaaccatgatggcacgtgtatacttatgtaacaaacctgcacatt
ctgcacatgcatcccagatatcaaagtaagattaaaaaataaataaaaatgaaaaagaca
aaaaaaaccccacagaaattattttttacctgcttctatgttgcccagtgtttcttcctt
tgtgttctgccacagatgacccagtgctcatgtctcatttctctttggtggcatctatct
tttcttacattttagactttttttttttttttttttgag >IGR3425a
tcaaagtaagattaaaaaataaataaaaatgaaaaagacaaaaaaaaccccacagaaatt
attttttacctgcttctatgttgcccagtgtttcttcctttgtgttctgccacagatgac
ccagtgctcatgtctcatttctctttggtggcatctatctttttcttacattttagactt
tttttttttttttttttgagatggagtctcactccgttgcctaggctggaatgcagtggc
aagatctcagctcactgcaacctccacctcccaggtgcaagtgattctcttgcttcagcc
tcctgagtagctgggattacatgcacatgccaccatgcctggctgattttttggtatttt
tagtagagatgggtttcaccatgttggccaggctagtcttgaactcctgacctcaggtg
atccacccgcctcagcctcccaaagtgctggaatgacaggcataagacaccatgcccggc
ccattttagactttttgattgccctatgatctcagttctctaatgagtttaggaaaagtt
atgattttgtagtttatctggctattgttgctgttaggatgtaatactcatcccagctttt
ccacatcctgcaatttcttgtgttttaagaattttttttaattttatactttaagttctg
gggtatctgtgcagaatgtgcagttttgttacataggtat >IGR3426a
gccctatgatctcagttctctaatgagtttaggaaaagttatgattttgtagtttatctg
gctattgttgctgttaggatgtaatactcatcccagctttccacatcctgcaatttcttt
gtgttttaagaattttttttaattttatactttaagttctggggtatctgtgcagaatgtg
cagttttgttacataggtatacacgtgccatggtggtttactgcacccatgaacctgtca
tctacattagttatttccctaatactatccctccctagccccaacttcccgacaggc
cctgaggtgtgatattcccctccctgtgtccatgtgttctcattgttcaactcccactta
tgagtgagaacatgcagtgtttggttttctgttcctgtgttaattttgctgagaatgatg
gtttccagcttcatccatgtccttgcaaaggactcatcgttttttatggctgcatagtat
tccatggtgtatatgtgccacattttcttttatccagtatatcactgatgggcatttgggt
tggttccaagtctttgctgttgtgtacagtgccgcaaataaacatacgtgtgcatgtgtc
ttcatagtacaatgatttataatctttgggtatatacccagtaatgggattgctgggtc
aaatagtagttctggttctagatccttgaggaatcaccac >IGR3427a
cattttcttttatccagtatatcactgatgggcatttgggttggttccaagtctttgctgt
tgtgtacagtgccgcaaataaacatacgtgtgcatgtgtcttcatagtacaatgatttat
aatctttgggtatatacccagtaatgggattgctgggtcaaatagtagttctggttctag
atccttgaggaatcaccacactgtcttccacaatggctgaactaatttacactcccacc
aacactgtaaaagtgttactatttctccacatcctctccagcatctgttgtttccagact
ttttaatgattgccattctaactggcgtgagatgggtatctcattgtgatttcgatttgc
atttctctaatgaccagtgatgatgagcttttttttcgtatgtttgttggctgcataaatg
tcttcttttgagaagtgtctgttcatatcctttgcccacttttttgatgggggttggttttt TABLE 5-continued ttcttgtaaatttgtttaagttccttgtagattctggatattagccctttgtcagatgga
tagattgcaaacattttctcccattctgcaggttgcctgttcactctgacgatagttttt
ttttctgtgcagaagctctttagtttaattagatcccatttgtcaattttggcttttgtt
gccattacttttggtgttttaatcatgaagtctttgtcca >IGR3428a
ttccttgtagattctggatattagccctttgtcagatggatagattgcaaacattttctc
ccattctgcaggttgcctgttcactctgacgatagttttttttctgtgcagaagctctt
tagtttaattagatcccatttgtcaattttggcttttgttgccattacttttggtgtttt
aatcatgaagtctttgtccatgcctatgtcctgaatggtattgcctaggttttcttctgg
ggttttatgattttgcgttttccatttaagtctttaatccatcttgagttaatttttgt
gtaaggtgtaaggaagggctcagtttcagttttctgcatatagctagccaattttccca
acaccatttattaaatagggaatcgtttcccccatttcttgttttttgtcaggtttgtcaaa
gatcagatggttgtacatatgtggtgttattttttgaggtctctgttctgttccattggtc
tatgtatctgttttggtaccactaccatgttttggttactatagccttgtagtatagttt
gaagtcaggtagcatgatgcccccaactttgtacttttttacttaggattgtcttggctat
gcagtctttttttaggttccacatgaaagctaaagtagttttttaccaaatctgtgaagaa
agtcaatggtaacttgatggggatagcactgaatctgtta >IGR3429a
actaccatgttttggttactatagccttgtagtatagtttgaagtcaggtagcatgatgc
ccccaactttgtacttttttacttaggattgtcttggctatgcagtctttttttaggttcc
acatgaaagctaaagtagttttttaccaaatctgtgaagaaagtcaatggtaacttgatgg
ggatagcactgaatctgttaattactttgggcagtatgccattttcatgatattgattct
tcctattcatgagcatagaatgtcttttccatttgtttgtgtcctctcttattttcttgat
cagtggtttgtagttcttgaagagatccttctcatcccttgtaagttgtattcctaggta
ttttattctctttgtagcaattttgactgggagttcacgcatgatttggttctctgtttg
tctgttattggtgtataagaatccttgtgattttttgcacattgatttttgtatcctgagac
tttgctgaagttgcttatcagcttaagaagattttgagctgagacaatgggattttctaa
atatagaatcatgtcatctgtaaacagagacaatttgacttcctcttttcctgtttgaat
acccttatttctttctcttgcccgattgccctggccagaacttccaatattattatgtt
gaataggagtggcgagagaggccatccttgtcttgtgctg >IGR3430a
gcttaagaagattttgagctgagacaatgggattttctaaatatagaatcatgtcatctg
taaacagagacaatttgacttcctcttttcctgtttgaatacccttatttctttctctt
gcccgattgccctggccagaacttccaatattattatgttgaataggagtggcgagagag
gccatccttgtcttgtgctggttttcaaaggaaatgcttccagcttttgcccattcagta
tgatattggctgtgggtttgtcataaatagctcttattattttgagatatgttccatgaa
tacctagtttattaagagtttttaacatgaagaggtgttgaattttgtcaaaggccttt
ctgcatctattgagataatcatgtggttttttgtcattggttctgtttattgtgatggatta
cacttatggatttgtgtatgttgaaccagccttgcatcccagaaatgaagccgagttgat
tgtggtggataacctttctgatgtgctgctagatttggtttgccagtatttttattgaggg
ttttcgcattgatgttcatcagggatattagcctgaaattttctgaataccaaagcctgg
cctgtctccaccaggttttggtatcaggatgatgctggcctcataaaatgagttagggg
gattccctcttttctcttgtttggaatagtttcagaagg >IGR3431a
atgtgctgctagatttggtttgccagtatttttattgagggttttcgcattgatgttcatc
agggatattagcctgaaattttctgaataccaaagcctggcctgtctccaccaggttttg
gtatcaggatgatgctggcctcataaaatgagttaggggggattccctcttttctcttg
tttgaatagtttcagaaggaatagtaccagctcctctttgtacctctggtagaatttgt
ctgtgaatctgtctggtcctgggctttttttggttggtaggctattaattactgcctcaa
tttcagagcctgttattggtctattcaggggatttgacttcctggtttagtcttgggt
gggtgtatgtgtccaggaatttatccatttcttctcaatttttctggtgtatttagatttc
tagtttatttgtattttcgtgggatcagtggggatatcctcttaccatgttttagcgtg
tctatttgattcttctctcctttcttctttattagtctgactagcggtctatctattta
ttgatcttttcaaaaaaccacctcctggattcatggattttttgaaggggttttttcatgtc
tctatctccttccaatctgctctgatcttagttatttcttgtcttctgctagcttttgaa
tttgtttactcttgcttctctagttttaattttgatgtta >IGR3432a
tttcttctttattagtctgactagcggtctatctatttattgatcttttcaaaaaaacca
cctcctggattcatggattttttgaagggttttttcatgtctctatctccttccaatctgc
tctgatcttagttatttcttgtcttctgctagcttttgaatttgtttactcttgcttctc
tagttttaattttgatgttaggatggagatttagatattcctgcttttctcttgtgggc
atttagtgctataaattttcctctaaacactgctttaaatgtgcccagggattctgtac
gttgtgtctttgttttcattggtttcaaagaacatcttcatttctgccttaatttcgtta
tttacccagtagtcattcaggagcaggttgttcagtttccatgtagttgtatggttttca
gtgagtttcttaatcctgagtcctaatttgattgcactgtggtatcgagaaactgtttgt
tatgatttctgttctttttccatttgctgaggagtgttttacttccaattatgtggtcaat
tttagaactagtgcaatgtggtgctgagaagaatgtataatttgttgatttggggtggag
agttctgatgtcttttatgtccacttggtccagagctgagtttaagtcctgaatatcctt
gtgaatttactgtctcattgatccttctaatattgatggt >IGR3433a
atttgctgaggagtgttttacttccaattatgtggtcaatttagaactagtgcaatgtg
gtgctgagaagaatgtataatttgttgatttggggtggagagttctgatgtcttttatgt
ccacttggtccagagctgagtttaagtcctgaatatccttgtgaatttactgtctcattg TABLE 5-continued atccttctaatattgatggtggggtgttaaagtctcccattattattgtgtggcagtctt
aagtctctttgtagatcttaagaacttgttttatgaatctgggtgctcttgtattgggtg
catatacatttaggatagttagcttttcttgttgcattgatccctttaccattatgtaat
gcccttctttgtctttttttgatctttgttggtttaaagtatgttttattagagactagga
ttgcaactcctgctttttttgcttccatttgcttgataaatattcctccatcccttttat
tttgagcctatgtgtgtcttttcacatgagatgggtctcctgaatacagcacactgatgg
gtcttgactcattacccaatttgccagtctgtcttttcactggggcatttagccagttta
catttaaggttaatattgttatgtgttaatttgatcctgtcattatgatactagctggtt
attttgcctgttagttgatgcagtttcttcatagtgtcaa >IGR3434a
ttcacatgagatgggtctcctgaatacagcacactgatgggtcttgactcattacccaat
ttgccagtctgtcttttcactggggcatttagccagtttacatttaaggttaatattgtt
atgtgttaatttgatcctgtcattatgatactagctggttattttgcctgttagttgatg
cagtttcttcatagtgtcaatgatctttacaatttggtatgttttttgcagtggctggtac
cagttgttccttttccatgtttagtcttccttcaggagctctggtaaggcaggcctggtgg
tgacaacatactcagcatttgcttgtctctcaaggattttatttctccttcacttatgaa
acttagtttggcttgatatgaaattctgggttgaaaaatcttttctttaagaatgttgaa
ttttagccctgactctcttctggcttctagggtttctgcagagtgatctgctgttagtct
gatgggcttccctttgtgggtaacccgacctttctctctggctgcccttaacattttttc
cttcatttcaaccttggtgaatctaatgattatgtgtcttggagttgctcttctcaagga
gtatctttgtggtgttctctgtatttcctgaattttaatgttgacctgtcttgctaggtt
ggggaagttctcctggataatatcctgaagtgtgttttcc >IGR3435a
taacccgacctttctctctggctgcccttaacattttttccttcatttcaaccttggtga
atctaatgattatgtgtcttggagttgctcttctcaaggagtatctttgtggtgttctct
gtatttcctgaattttaatgttgacctgtcttgctaggttggggaagttctcctggataa
tatcctgaagtgtgttttccaacttggttccattctccccattacttttcaggtacaccaa
tcaaacataggtttggtccttttcacatagtcccatatttctcggaggctttgttcgttcc
ttttttattctttttttctccgatcttgtcttctcgctttatttcgttaagttgatctccaa
tttctaatatcctttcttctgcttgactgattcagctattgatacttgtgtatgcctcat
gaagttcttgtgctgtgttttcagctccatcacgttatgttcttctctaaactggttat
tctagtcagcaattcatctaaccttttttcaaggttcttagcttccttgcattgggttag
aacatgctcctttagctcagatgagtttgttattacccaccttctgaaacctacttttgt
caattcatcgaactcattctctttccagttttttttctcttgctggcgaggagttgtgatg
ctttggagaagaggtttttttggttttttggaattttcagcg >IGR3436a
accttttttcaaggttcttagcttccttgcattgggttagaacatgctcctttagctcag
atgagtttgttattacccaccttctgaaacctacttttgtcaattcatcgaactcattct
ctttccagttttttttctcttgctggcgaggagttgtgatgctttggagaagaggttttttt
ggttttttggaattttcagcgttttttgcactggtttctccccatctttgtggatttatcta
cctttggtctttgatgtaggtgaccttcggatggggtctctgttagttttccttctaata
gtcagggccctctgctgcaggtctgctgtagtttgctggaagtccattccagatcctgtt
ttcctgggtatcaccagtggaggctgcagaacagcaaagattgctgcctcttccttttggg
aagcttcatcccagaagggcacctgccagatgccagccagagctctcctgtatgaggtgt
ctgttggcccctactgggaggtttctcccagttaggatatatggaggtcagggagccagt
tgaagaggcagtctcacccttagcaaagctcaaatgctgtgctgggagatctgtgctcttt
cagagctgtcaggcagggacttttaagtctgatgaagctgcacccacagccgcctcttcc
tccaggtgctctgtcccagggagatgggggttttatctgt >IGR3437a
gtttctcccagttaggatatatggaggtcagggagccagttgaagaggcagtctcaccct
tagcaaagctcaaatgctgtgctgggagatctgtgctcttcagagctgtcaggcagggac
ttttaagtctgatgaagctgcacccacagccgcctcttcctccaggtgctctgtcccagg
gagatgggggttttatctgtaagcccctgattgggctgctgccttttttcagaggtgc
cttgcccagggaggaggaatctagagaggcagtctggccacagtggccttgctgagctgc
agtgggctccacccagtttgaacttccaggtggctttgtttacactgtgagggtaaaacc
acctactcaagcctcagcaatggcggatgcccctcccccaccaagctcaagcatcccaa
gttgacctcagactgctgtgctggcagcgagaatttcaaggcagtggatcttagcttgct
gggctccatggaggtgagacccaccaagcccaaccacttggcttcctggcttcagccccc
tttccaggggagtgaatggttctgtctcgctggcattccaggtgccactggggtatggaa
aaaaaaagtcctgcagctaactcagtgtctcctgaatggctgcccagttttgtgcttga
aacccagggccctggtggtataggcacgtggtctgggggt >IGR3438a
ccaccaagcccaaccacttggcttcctggcttcagccccctttccaggggagtgaatggt
tctgtctcgctggcattccaggtgccactggggtatggaaaaaaaaagtcctgcagcta
actcagtgtctcctgaatggctgcccagttttgtgcttgaaacccagggccctggtggta
taggcacgtggtctgggggttgtgaagaccgtgggaaaagtgcagtatctgggccagagt
acactgttcctcaggctcagcccctcacagcttcccttgggtaggggagataattccctg
accccttgcgtttcctgggtgaggcgatgccccaactgcttccgctcgccctccgtgggc
tgcacccactgtccacccagtcccagtgagatgaaccaggtacctcagttggaaatgcag
aaatcacccaccttctgcatcgatcttgctgggagctgcagaccggagctgttcctattc
agccatcttgccaactctctcttaagaattttttactataatctatttcatatgttctac
tgtatacaatgccaattgatgtttgcttttattttttgcaatttagtgactttaaaaaa
ttgagattttttgtaaaagaatatttctgttcttatagcattgcagtcaaagaatatgggc
aataaaatttctgctttgagaaatttgctgaggttgtttt TABLE 5-continued >IGR3439a
cttaagaattttttactataatctatttcatatgttctactgtatacaatgccaattgat
gtttgcttttatttatttgcaatttagtgacttttaaaaaattgagattttttgtaaaagaa
tattctgttcttatagcattgcagtcaaagaatatgggcaataaaatttctgctttgag
aaatttgctgaggttgtttttatgacttttaagagtaatgtatagccaatgtttatggg
ctatagtgtttaatgtctctcttaagccaagtttattaattattaataatagtcaatttc
tcttcttcatgaaagaaatacgttcacgatgttcattattatcatggtttttatcagtttt
atcttgaattttctttattccttgttgttttggttattttgtaaactgttattcagccca
gaaattgttacgaatgtttgtcttcattctgtattatcatagcaaaatagtcctctgatt
tcattgtctattactgcttctgatttcttattttatgtattttgcccatctattttaat
ccatttgcttgtgtctatatccactgctaaaacccaagtccacgtttactgtgatccatt
ttctagactattgacataggttcctacttggtgttcttgcctcgtcttttaccaacaaca
atttattgttcacccagcagccaaagggaatattttccag >IGR3440a
tgatttcttattttatgtattttttgcccatctattttaatccatttgcttgtgtctatat
ccactgctaaaacccaagtccacgtttactgtgatccattttctagactattgacatagg
ttcctacttggtgttcttgcctcgtcttttaccaacaacaatttattgttcacccagcag
ccaaagggaatattttccagccaaaagccctctcatgacttccctcacacttatgcttct
tatcatgcctctcctcttcatgtatatatgtataagcagcccacagcatacttctccaccctcatctc
ctactgctctcctctttgctcactgtgctctagacatactgacccttatttctcctcctta
actatgctatatgtttccctcagggccttttgcggtagctagtatctgtacctagagggct
cctttttcatgatgaatgctttttttttcattgatgactaagtacacttgtcacctcttcag
agaattcttccctgacacctaaagtagccattccatcactaagtcattcttatgttttat
tttttcttcaaagcatttatcaatatctgaaatattcttgattgtttattcttttactca
gtaaaagcgattaccttgtatgagttgttgactgttatattgctgacatctgtgaccctg
cacatctcaagcaagtgacgtgggagtgggagttgtgata >IGR3441a
aaagtagccattccatcactaagtcattcttatgttttattttttcttcaaagcatttat
caatatctgaaatattcttgattgtttattcttttactcagtaaaagcgattaccttgta
tgagttgttgactgttatattgctgacatctgtgaccctgcacatctcaagcaagtgacg
tgggagtgggagttgtgataaagtcaagagtcaggcctgatatagagaattgtctgtcat
taaaaggaggttttccaaccttggagagtcagaggaaatggagactggcctagctatccc
tgaaggtgaaataaatatatttataaactagagccacctctcagttatctgtatgatccc
aggcagaaacacttagcatggtttctgatacagagttggtactcagaatgcatttcttga
aatgaatcaaagtatactgactgattgctgtatgcctctgtcctaggtgctatgggaaat
tcagggataataaaagcacagcccatcctacaaggatgctacatctagcaggggatatta
gccatttgaagagttaaataataaccacagatttctcaagaaatctagatgtgctgaaag
aagggagggcttcctcccaactggatagttggggaaggtttccaaaaagggacaatatta
gctacatcttgaagaagtggttggaaaaaggaaggatgtg >IGR3442a
gcccatcctacaaggatgctacatctagcaggggatattagccatttgaagagttaaata
ataaccacagatttctcaagaaatctagatgtgctgaaagaagggagggcttcctcccaa
ctggatagttggggaaggtttccaaaaagggacaatattagctacatcttgaagaagtgg
ttggaaaaaggaaggatgtggtttgggtggactagagagtgggagtaactgataaagatg
ttgtagaggccctaatgagcatgacgtgtgggagaagtaaaagggttcatttggggtaga
aaaggcatacagggcatagagtacttaggtcctgacccagtgagcattcatcttgattgc
taagcttaggatttgggccttttacgttgtggctacaggaaggtattggaagcctttgagc
caggaagaaagaattatagtttagaagtgcttcaagaagttctattctgcattaagacaag
ggccattaaaaaaaaaaaaaaactccattgatgcaagatgtctccttttgtctttttc
tgcctttacccatctgcctccccccaccccaccctctctcaatgtggtctcactctca
cccaggctggagtgcagtggtgtgatcacagctcattatagcctcaaactcctgggctca
agcagtctttcctcctcagcctcccaagtagttacaacta >IGR3443a
aaaactccattgatgcaagatgtctccttttgtctttttctgcctttacccatctgcct
ccccccaccccaccctctctcaatgtggtctcactctcacccaggctggagtgcagtgg
tgtgatcacagctcattatagcctcaaactcctgggctcaagcagtctttcctcctcagc
ctcccaagtagttacaactacaggtacatgtcaccatgcccggctaattattaaaagttt
tttcttgtagagacaaggtctcactatgtcacccagcctggtttaaaactcctggcctcaa
gtgatcctcctgcctcagcctcccaaagcactagtattacattcatgagccactgctccc
agcttgccttttctctatttcttcccttccccaacctggatcagcctcctgggatattc
cctggagtgacctctgattactaccatccccaaagcagtaacaaggtcagcatcagacag
tttatttgctagtggctactgcagtctgaaccctggctagcatgtcagatatggcagaga
tattagagttttccaaaggggaattctgcatcctggatacctgaaatagagactatgttt
ggggataagtagactactttgatgccttcagtgttgaactcatgggttctgggtagcca
ggggcattatccaacatcaaaaaagcttttaaaggcaatc >IGR3444a
gcagtctgaaccctggctagcatgtcagatatggcagagatattagagttttccaaaggg
gaattctgcatcctggatacctgaaatagagactatgtttggggataagtagactacttt
gatgccttcagtgttgaactcatgggttctgggtagccaggggcattatccaacatcaa
aaaagcttttaaaggcaatcccttactcacaaggtacttcctgacctcagggacaaagca
ttgatggaaccaatacagaaaaaggatttttcatcatccaggccttcttctacagctgaaa
gactggcagctggtatacaactgttccctgcaaggattgggagttagcagctttatggat
aagggcaatgctagtgcttgcttctgttccttactaataaatatcgtttgtgacacttttt TABLE 5-continued tttcagaataagggcatttttgtctgtattaaaaacctgttgaggcaggtatcctttgtcc
tcaattattttcttaatgatacctgggaacctatctcctgcctttggtcagcagaaactg
cttctcctattaccttgatatttttaaggccaaacctcttgctaaaattatcaaaccatc
ctttgctggcattaaattttcagctttagctccttcaccttcctatttgtttgtttatt
tatttaagacagaatctcgctctgtctcccaggctggagt >IGR3445a
acctgggaacctatctcctgcctttggtcagcagaaactgcttctcctattaccttgata
tttttaaggccaaacctcttgctaaaattatcaaaccatcctttgctggcattaaattttt
tcagctttagctccttcaccttcctatttgtttgtttatttatttaagacagaatctcgc
tctgtctcccaggctggagtgcagtggtgcaatcttggctaactgcaacttccacctccc
aggttcaagtgattcttgtgctgcatcctcctgaatacctgggattacaggcatgtgcca
caatgcccagctaattttgtattttagtagagatgggggttccaccatgttggccaggc
aggtctcaaactccctcctgacctcaggtgatcaggccgcttcgacctcccaaagtgttg
ggattacagccatgagccagtgtacctggcctcttcaccttccttttggtttatgttgtc
atataatgactctgcttttctcaagtcacagtagggtctatagttataccctttcttcta
gcaatcctctacccacataaagctgcaatttcaatatgagataaaaagatatttcacaaa
aaaatgcaaggtttttggacatggtgacatagctgtggtgatggcttcataaatttcatt
ttcttttttaacaatggtccttacactagattcatttatc >IGR3446a
ctcaagtcacagtagggtctatagttataccctttcttctagcaatcctctacccacataa
agctgcaatttcaatatgagataaaaagatatttcacaaaaaaatgcaaggtttttggac
atggtgacatagctgtggtgatggcttcataaatttcattttcttttttaacaatggtcc
ttacactagattcatttatcttgaaatggtgacacactgcagctgcagacctcaatgta
cagtacatattaatggattcagttttttcttaatgtcatgacttttctttgcttcttggga
gcactttccagcatggttggaaagttgaggcctctttcaactcatcactctttcttcctg
ggtccctctctatggaaaacaggtaagtcaaatttcaaaactgtgcactatggttccaac
catagtttcctttggccacttgccaaagtgggacttctcactaatggggagtaaaaatgaa
ggtttttatccagattatcagtaggatcacactgttctgtcattcggtttgctagacttgt
ttcatataactcagtttcaccaatatagcacctttccttgggcttttctgaaaatatcac
ttgtacaagattttttgtgtgagcagattcgtgagaagacttgcggtgccaaatgtgtt
ttatgttgccatggtgcttgctcttagcttcatctgtcat >IGR3447a
taggatcacactgttctgtcattcggtttgctagacttgtttcatataactcagtttcac
caatatagcacctttccttgggcttttctgaaaatatcacttgtacaagattttttgtgtg
tgagcagattcgtgagaagacttgcggtgccaaatgtgttttatgttgccatggtgcttg
ctcttagcttcatctgtcatgagggttttgtttctcatagtagtgttttctcctaccaaa
ttccactacacatcctctcctacccttggtaaaccctgccccaaacaaacagagcaatt
aatctagaactgtgttgtccagtacagtagccattagccatatatggctatttaattaaa
tatggccaattaattaaaattaaataaaattagaaatttaaaactctcagttgccgtaac
catatttcaggtgttcaatagccacatgtgctagtagcttctacattggacagtgcagat
atacaacattctgattaccacagaaagttctattggataatgctaatctagaataatact
gccaaattccagcaggactatcaaggtagatgtaagtactccaaggcacattcctatcac
gttccctgttgccactatagaaagtataacttcttcattattccagttgcccatctggta
actattagatcaggcacacgtgcacatgcacgcacacaca >IGR3448a
cagaaagttctattggataatgctaatctagaataatactgccaaattccagcaggacta
tcaaggtagatgtaagtactccaaggcacattcctatcacgttccctgttgccactatag
aaagtataacttcttcattattccagttgcccatctggtaactattagatcaggcacacg
tgcacatgcacgcacacacacacacagacacacacacacacacattaattcttacaga
ctggatattctaaatttacaagaaggaggaaaagcattttcctaattgctccaaaatttt
ctctacccataataaagcgagtaccttacattattttgcaaagaagtccctcactttcaa
attgtgccccttgggcctggcataaataagaaaacaaacccatttttgaagctatctca
tttaatgaaaggtcattcagctataaaaggatgcaaagaaagttttttcttatctattcct
tttaagaccctaattatgttctcacctattccccagttcctgctgagtctctgaaggtag
gagtgggaagtcttgcattggaaaggccttcttaggtgcagtagtatttgttatttttaca
ccttaacctcaaaggaagtccttcttttcttgggatggagcactttagttctcataact
cttctctgaagtcattgcagagtgggtggaggaaggtgag >IGR3449a
ctcacctattccccagttcctgctgagtctctgaaggtaggagtggg tgcattg
gaaaggccttcttaggtgcagtagtatttgttatttttacaccttaacctcaaaggaagtc
cttcttttttcttgggatggagcactttagttctcataactcttctctgaagtcattgcag
agtgggtggaggaaggtgagggtgatgctttggtctgaattttcttggtaaacttacaag
tggatctatcaaaaccagagggttttttcttaaccacaccaccccccagaattccatttcc
tgcagatgtagcagcagcacgtctagccatcttgcccaggcctctggaccatgccttgg
gagggctctgccctctgccttgagttccattagaacttctccagtggaaagagtgagtta
ctttgccctggcctggtgggcaggcttttcctctctgacttggctaaatgaaatgggat
ttaaggtagctctccctgtgggtaaaagacattttgctctatgctagagaaaaagggagg
tagtggtttcatctgccactactacctatggatgtgaacagaacctctgctcctgatgca
gaccccctggcccttttcccagctcctattctgttttgacttctgcacacccttttttctga
ccctgatactatcccagatcattattcttcctctagtcct >IGR3450a
ggtaaaagacattttgctctatgctagagaaaaagggaggtagtggtttcatctgccact
actacctatggatgtgaacagaacctctgctcctgatgcagaccccctggcccttcccag TABLE 5-continued ctcctattctgttttgacttctgcacaccccttttctgaccctgatactatcccagatc
attattcttcctctagtcctacccttgttctagccagtgccccagacccaaggtgagcta
agggacagtctctcaaagtctgggcagagagcctcaggaagttggggtatggctgagaga
agaggggagtgcagggggataggcatacagactctgaatgcttgaccttccttattttct
gtctttgaacttatttcaacagaggaacccttatcatctagccctgtggctctctagtac
cttgtacctgcttcctgtcccataattgtgagcgtttagctgtggtgcaggtgagagacc
cattctcccaccctcaggagccaggaaggcccaccagtatggcagggaggcctaggcaga
gatatacaggagagcagagacgtctggagctaggtcaccggtggtcagcagggcctcctg
cagagggagcagcctcctttggcctttgcttgtctgacttctaatgatcctgtaaaaatt
agttttgttttttaagcaccccaatgatgcatgaatacac >IGR3451a
ccaggaaggcccaccagtatggcagggaggcctaggcagagatatacaggagagcagaga
cgtctggagctaggtcaccggtggtcagcagggcctcctgcagagggagcagcctccttt
ggcctttgcttgtctgacttctaatgatcctgtaaaaattagttttgttttttaagcacc
ccaatgatgcatgaatacactcttttgtcaaatcttaaaaagagaaaatcctttttttttt
tttaaataaaaaagaaagttatttagtcttaagattgtaaaactgtaaagttaaataaag
tggccgcccttggctgccctgatccccatccccactccagcttctgcaagtaaccaca
attctcagctaggtgtatatccttccagacgtctttctatacatttacttttccttattg
tttaaaccaatttgagttgtcttttctcttacttaaatctgaaagtgttcctaaccaatt
taataacaattgcctcagagctgtttattgaaaggttcttcgtttcatactgacataaaa
cgccagttgtgttagaccctggccaggcctgcttcctcaaagacccagagtaaacatgaa
ctgtaaactccaaaactgtacaactagttttttaaagaaagattgcccaagatactggcac
aagacttttaaggcctaggatttgcatattagacctatg >IGR3452a
ctgtttattgaaaggttcttcgtttcatactgacataaaacgccagttgtgttagaccct
ggccaggcctgcttcctcaaagacccagagtaaacatgaactgtaaactccaaaactgta
caactagttttttaaagaaagattgcccaagatactggcacaagacttttaaggcctagg
atttgcatattagacctatgtaatgtggcttactgaagagcagagttcttgctttctttg
gtagtgtaagctctttctggtgctcacacaggaaggactgtaaagggcagtgagggctcg
aatctggactcttctgacatgagggacatctcattttatgcaggctgccaagaccattga
acttggaggatgcctttgtgagaaagcaagaaaggcagtggggagctgcagccccccacat
gcaccttcatctcaggaacatcctttgtactttttttttttaatattgtacagagctgttt
tttttattatactttaagttttagggtacatgtgcacaacatgcaggttagttacatat
gtatacatgtgccatgttggtgtgctgcacccattaactcgtcatttaacattaggtata
tctcctaatgctatccctccccgctcccccccaccacaacagccccagtgtgtgatgttc
ccttcctgtgaccatgtgttctcattgttcagttcccac >IGR3453a
tttagggtacatgtgcacaacatgcaggttagttacatatgtatacatgtgccatgttgg
tgtgctgcacccattaactcgtcatttaacattaggtatatctcctaatgctatccctcc
ccgctcccccccaccacaacagccccagtgtgtgatgttccccttcctgtgaccatgtgt
tctcattgttcagttcccacctatgagtgagaacatacggtgtttggttttttgtccttg
cgatnnttttgctnagaatgatggtttccagcttcatccatgtccctacaaaggacatgaa
ctcatccttttttatggctgcatagtattccatggnntatatgtgccacattttcttaat
ccagtcnatcattgttggacatttgggttgnttccaagtctttgctattgtgantagtgc
cacantaaacatacgtgtgcatgtgtctttatagcagnatgatttataatcctttgggta
tatacccagtaatgggatggctgggtcaaatggtatttctagttcnagatccntgagnaa
tcnccacactgncttccacaatggttgaactantttacantnccaccaacagtgtaaaan
tgttcctatttcnccacatccncnccagcacctgttgtttcctnacttttnaatnancac
nnttnnaactggtgtgagatggtatctcattgtggttttg >IGR3454a
ctgggtcaaatggtatttctagttcnagatccntgagnaatcnccacactgncttccaca
atggttgaactantttacantnccaccaacagtgtaaaantgttcctatttcnccacatc
cncnccagcacctgttgtttcctnacttttnaatnancacnnttnnaactggtgtgagat
ggtatctcattgtggttttgatttgcatttctctgatgccagtgatgatgagcatttttc
atgtgtcttttggctgtgtaaatatcttcttttgagaagtgtctgttcatatccttcgcc
cacttttgatgggttttttttcttgtaaatttgagttcattgtagattctggatattag
ccctttgtcagatgaatagattgcaaaaattttctcccattctgtaggttgcctgttcac
tctgatggtagtttcttttgctgtgcagaagctctttagtttaattagatcccatttgtc
aattttggcttttgttgccattgcttttggtgttttagacatgaagtccttgcccatgtc
tatgtcctgaatggtattgcctaggttttcttctagggttttatggtttcaggtctaac
atgtaagtctttaatccatcttgaattaattttgtataaggtgtaaggaagggatccag
tttcagctttctacatatggctagccagttttcccagcac >IGR3455a
ttgcttttggtgttttagacatgaagtccttgcccatgtctatgtcctgaatggtattgc
ctaggttttcttctagggttttatggtttcaggtctaacatgtaagtctttaatccatc
ttgaattaattttgtataaggtgtaaggaagggatccagtttcagctttctacatatgg
ctagccagttttcccagcaccatttattaaataggaatcgtttccccatttcttgtttt
tgtcaggtttgtcaaagatcaggtcgttgtagatatgcggcattatttctgagggctctg
ttcggttccattggtctatatctctgttttggtaccagtaccatgctgttttggttactg
tagccttgtagtatagttagaagtgaggtagcatgatgctccagctttgttttttttggct
taggattgactctgcaatgtgggctcttttttggttccatatgaacttgaaagtagtttt
ttccaattctgtgaagaaagtcattggtagcttgatggggatggcattgaatctataaat TABLE 5-continued taccttgggcagtatggccattttcatgatattggttcttcctacccatgagcatggaat
gttcttccgtttgtttgtatcctcttttatttcattgagcagtggttagtagttctcctt
gaagaggtccttcatgtccttgtaagttggattcctagg >IGR3456a
tcattggtagcttgatggggatggcattgaatctataaattaccttgggcagtatggcca
ttttcatgatattggttcttcctacccatgagcatggaatgttcttccgtttgtttgtat
cctcttttatttcattgagcagtggttagtagttctccttgaagaggtccttcatgtccc
ttgtaagttggattcctaggtattttattctctttgaagcaattgtgaatgggagttcac
tcattgtttggctctctgtttgtgtgttattggtgtataagaatgcttgtgattttgta
cattgattttgtatcctgagactttgctgaagttgcttatcagcttaaggagattttggg
ctgagacaatggggttttctagatatacaatcatgtcacctgcaaacagggacaatttca
cttcctcttttcctaaatgaatacccttttatttccttctcctgcctgattgccctggcca
gaacttccaacactatgttgaataggagtggtgagagagggcatccctgtcttgtgccag
ttttcaaagggaatgcttccagttttttgcccattcagtatgatattagctgtgggtttgt
catagatagctcttattattttgagatatgtcccatcaataccctaatttattgagagttt
ttagcatgaagggttgttgaattttgtcaaaggcctttttc >IGR3457a
aataggagtggtgagagagggcatccctgtcttgtgccagttttcaaagggaatgcttcc
agttttttgcccattcagtatgatattagctgtgggtttgtcatagatagctcttattatt
ttgagatatgtcccatcaataccctaatttattgagagttttttagcatgaagggttgttga
attttgtcaaaggccttttctgcatcgtgttgagataatcatattgttttttgtcattggtt
ctgtttatatgctggattacatttattgattttcatatgttgaaccagccttgcatccta
gggatgaagcccacttgatcatggtggataagcttttgatgtgctactggatttgattt
gccagtattttattgaggattttttgcatcgatgttcatcagggatattggtctaaaattc
tcttttttttgttgtgtctctgccaggctttggtgtcaggatgatgctggcctcataaaat
gagttagggaggattccctcttttttctattgattggaatagtttcagaaggaatggtacc
agctcctccttgtacctctggtggaattcggctgtgaatccatctggtcctggactttttt
ttgtttggtaagctattaattactgcctcaatttcagagcctgttattggtctattcaga
gattcagcttcttcctggtttagtcttgggagagtgtatg >IGR3458a
tttttctattgattggaatagtttcagaaggaatggtaccagctcctccttgtacctctg
gtggaattcggctgtgaatccatctggtcctggactttttttgtttggtaagctattaat
tactgcctcaatttcagagcctgttattggtctattcagagattcagcttcttcctggtt
tagtcttgggagagtgtatgtgtcgaggaatttatccatttcttccagattttctagttt
atttgcatagaggtgtttatagtattctctctctttttttttttttttttttttttgagac
agagtctcactctgtcacccaggctgtagagcagtggtgcaatcttggctcattgaaacc
tccacctcccaggttcaagcaattcttgtgcctcagcctctggagtagctgagattacag
gcacacactcccatgcccggataatttttttttttttttttttttaagtagagatggg
gtttcaccatgttggccaggctgatctcgaactcctgatctcaagtgatctgcctgtctc
ccaaagtgctgggattacaagcatgagccactgcgcctggccggtttctggtataattct
tgatcttattaaggatgcttcctagtagtcctagtagacaaagaattttttctcataaacg
gatgtttctgttgagatgatcatctttagattaaccaatt >IGR3459a
ctgatctcgaactcctgatctcaagtgatctgcctgtctcccaaagtgctgggattacaa
gcatgagccactgcgcctggccggtttctggtataattcttgatcttattaaggatgctt
cctagtagtcctagtagacaaagaattttttctcataaacggatgtttctgttgagatgat
catctttagattaaccaattattgtgagaagtacattggtagattttccataatcaaat
ttgcattcctgggaatgaccctgcttgatcatgatctgttattcttttaattcaatttgg
taatgtcttattcctactgagttctacctcagtaaaaattttcaccaaaactgtgcctag
cctccaggctgggtggcatgttccttctctatgcaccgagagcaccatgtctgtcttttt
ctaatacctctctagttttgtacttacaatctggtattataattacatgtctccctcagt
ggaatatgccattgttgagagacagacttttgtcttcttcctaattgtatcctcagtgcc
cagataaggcctgatttaaagcaggcctttggaaaatatgtctagtctgtgcgaaaatgc
ttaccattcccctgacagggacaagtgccaagtccccatactagtttagctttgtgcgca
gagccctggccttgttggtccagcttatcatgcagacaag >IGR3460a
gacagacttttgtcttcttcctaattgtatcctcagtgcccagataaggcctgatttaaa
gcaggcctttggaaaatatgtctagtctgtgcgaaaatgcttaccattcccctgacaggg
acaagtgccaagtccccatactagtttagctttgtgcgcagagccctggccttgttggtc
cagcttatcatgcagacaagagccatgtcaatactggtggacccgcttgctgtgggagc
tggagagccagatatgctcacagctccttctcagttacacctaagctgcctgtgggagg
tcaggactctgcatgcgcctccacatcttcaggccgaagattctccatcacttccaagaa
agcacgctcaaatgtgaaagcagataaatcattagcaccctgtgctgggcttgttactg
ttcaacaggggttctctttctgggaacctaagatacttcatgtgtaccttagcagcagct
aatgggggtggatggaagtggtcaccaggcattccagtcacccagggatgcctaggtccc
tttaccaggaagcagcgagagaggcataatggacacaactctgtctttcttatagaagac
acctgtttcaggccaggcctttatcttgctgaagctgaccccactgaagggtcattgtgc
tttggttagaaaaccactgcaaccaaagccatccagtgac >IGR3461a
gtcaccaggcattccagtcacccagggatgcctaggtcccttaccaggaagcagcgaga
gaggcataatggacacaactctgtctttcttatagaagacacctgtttcaggccaggcct
ttatcttgctgaagctgaccccactgaagggtcattgtgctttggttagaaaaccactgc
aaccaaagccatccagtgacaaagtagtgggatccctcatactggagcaggcagacacct TABLE 5-continued actgtcccagtagtctcatgtcagaaacaacactcaacatacattgtcttttgtgcccag
cttgggagctggtctgtgaggactgagggatcccaggtaccttgagttcttgtaaccata
cagtggatggacacagacacagcaccatcctagggctggcagatactccatgctcatcgg
tgccagcctgctcatcaacagaatcacccacctccattctgtcacccaccaggtatttac
tgagactcttctacatgacatgtgccattgagggtactgggagaatagcagcagacntat
aatacaaaagcccctgcccttgagggggctacctggtttccaggtgcaccccagttta
tctcatggtttaggtggcactatttatgactcaccaagtttgtgacagatgatcagtgtc
ttccttctgtggctgcagtttatctgtgcacagatgctgg >IGR3462a
tgtgccattgagggtactgggagaatagcagcagacntataatacaaaagcccctgccct
tgagggggctacctggtttccaggtgcaccccagtttatctcatggtttaggtggcac
tatttatgactcaccaagtttgtgacagatgatcagtgtcttccttctgtggctgcagtt
tatctgtgcacagatgctggcatccttcaatccaggtctcaggtttgggtcagggcttag
cttgaggcagtaggaagaacagagctctctggatggtttaggcaagcttgtccaacccat
gactcacaggctgtatactacccatgacagctttgaatgtgacccaacataaattggtaa
actttcctaaaacattatgagattttttgctttcttttttttttttttttttttttttg
ctcatcagctattgttagtgttagtgaattttatgtgtggcccaagacaattcttcttcc
aaagtgggcccagggaaaccaaaagattggacatctctggtttagagattcagttggtttc
ttcaacttcagttcttggtgtacagggatggcctctgacttgctccacatcctcaatccg
gccaccacctggttttctgcacacaggaaacacttggcaatgttggctgaaacaatgagt
gagagccaagtgccaagtgctgggctaacctcgctcacag >IGR3463a
aaagattggacatctctggtttagagattcagttggtttcttcaacttcagttcttggtg
tacagggatggcctctgacttgctccacatcctcaatccggccaccacctggttttctgc
acacaggaaacacttggcaatgttggctgaaacaatgagtgagagccaagtgccaagtgc
tgggctaacctcgctcacagccaattaggcataaagtaaccagggctgtaagagaagtgg
aaacagagatgcagatgctccaaggaggccagacacttgccctcctctcttggtgagtcc
tgtgctcagaaggggcacaacggagacgtgcttgggctgtccatacggcagtctctctgc
ggcagtggagaaagctctggtctgtgtgtatagtgtgcatgcaggggagtgtgcatatgt
gtgtatatttgcctacatgcacatgcatgttcacattggctctggtccccacaacaacac
cattataggccctgcttagccatcctttctgcagtgggggggggaggggggaaagggt
tcctgactgctgtgtcacttttggatagtcactgttttttgtgtgcagcactcctacctc
acctaccccaccccctagaggcaggcagggtgatgactgaagcatcaggcctgtggtttct
gtaacaggaagtgatttagatgctgaaagctaattttaga >IGR3464a
ccatcctttctgcagtggggggggggagggggaaaggggttcctgactgctgtgtcactt
ttggatagtcactgttttttgtgtgcagcactcctacctcacctaccccaccccctagagg
caggcagggtgatgactgaagcatcaggcctgtggtttctgtaacaggaagtgatttgaga
tgctgaaagctaattttagatgaaatgatatgggggttttaaagaatctttcagggttgg
tttcaggctcaaggcttagccccctgctcctcttgcctacagggacaggcagtttccca
ttgtccttgtcactgtctngctgggtgaactcatgcctagctgggcagggttcttaggta
gaaagccagtgctgatttttcctggatttcagaatgtttaagtcattgttttttggccttg
aacaccagagtcctgtgactcagcacaggcctggctctaggccaagcagcacacaggacct
cttatccctggaagggactgcctggaggctcccaaggatcttgttaggacagagatgtc
caccctcacccaggctgaggcctgggccagaggtcagatgaggcttctgggccaaaaaaa
gtatcatcttgggtggcagacacttaggtggggcctcttctcccagttagccctgtcctg
agcctcttagcaggggcggctttctgacccaggtgccaca >IGR3465a
gcctggaggctcccaaggatcttgttaggacagagatgtccaccctcacccaggctgagg
cctgggccagaggtcagatgaggcttctgggccaaaaaaagtatcatcttgggtggcaga
cacttaggtggggcctcttctcccagttagccctgtcctgagcctcttagcaggggcggc
tttctgacccaggtgccacacactaaggatcccatcctgattgagccctgtagattgggact
cctgatagcagcagacacaaaagaaactgaggagtaggcacagaactctgagagtcctgt
cctcctggtgtcgggtcccactggttggggaccttggagcctcatggtttctgtctctg
ccaaggcctgagcacagaaatagaaggttgggcctccctggtcacctctgcaagggtct
tcaaagcccatttaatctgttgtcccattccctaggtcttccacagcacccctatacca
gagaatgctgctcccattatcagagaagcagccaaatatcagcatgctaagagagatgtc
ccagggttacatagcttcactcaggcagcattggagccagccaggccaggagcttaccct
gtcccatactaccgatgggatgcccagcattcagggaaaagagctcactctgcatatctc
atctagacagcagccagcctcatgaaccctaccacaaac >IGR3466a
cagagaagcagccaaatatcagcatgctaagagagatgtcccagggttacatagcttcac
tcaggcagcattggagccagccaggccaggagcttaccctgtcccatactaccgatggga
tgcccagcattcagggaaaagagctcactctgcatatctcatctagacagcagcagcct
catgaaccctaccacaaacctgggacctctggaaagccaagtataagtctctgccagtt
cttagtccaccttgttctgctttgtggtgaggtatagcttgggagatgaggcgaggcct
ataggtcttggttggtacacaagaagaaacacttctgcctagagaggctgtcgacagaca
tttccagggacacacagcagacagccttcatggccttcatgaccagtcggtcccttgtgg
aagacaagtaggacaggacagatgattagcccagagccaaaactgagctcaaaccgcaga
agaggagagcattctcacaaaagctccagtgtttgcagcacaatgacggaggtagatggt
gtgagctaagccctgttttgagagttccatagaaggtgtctttgacctattttcaagggc
tgtggtggtaggaggaattttttggccacatcataaagagttttgtggccacctctgatat
acctagctcaggaagttgtaattttccatgattaggttat TABLE 5-continued >IGR3467a
aagctccagtgtttgcagcacaatgacggaggtagatggtgtgagctaagccctgttttg
agagttccatagaaggtgtctttgacctattttcaagggctgtggtggtaggaggaattt
ttggccacatcataaagagttttgtggccacctctgatatacctagctcaggaagttgta
attttccatgattaggttattagtcaccaaagtgattgctgcccccagaccctggcccct
gtgctgcaggaggctgacagagatgcccctccagcactgcagccctgcctccccagctgc
aggccagaagccaaggaggccctgagtactgatgttgggccctctgggtgcttcccttgt
ttgtggaacccacagcccccattccaacttcttgagcactttgcctacccccaggagattt
aactggggcaagaaatcctgtaagatctcaacaaacggacgtgggtagaatagctcccag
aaaatctactcaagggaagacccatgtactccaaggtatcaataatggtgagggactcag
tctgtaactttctaggacagtttcatttcattttaaaaatttaagatgaaagaatttatt
aatggaagtagttcatgaagcactttcaggaaaccacacaggactcagagctccttgcct
ttagaaagacaggactgtgtcagcctgtgtggcattcaca >IGR3468a
cccatgtactccaaggtatcaataatggtgagggactcagtctgtaactttctaggacag
tttcatttcattttaaaaatttaagatgaaagaatttattaatggaagtagttcatgaag
cactttcaggaaaccacacaggactcagagctccttgcctttagaaagacaggactgtgt
cagcctgtgtggcattcacacctggattcccaggtgggcttcccttagaaagggagaat
tagttgcagcccatctctctgtgggaatctcacctggtgagccccttctcccaaactcct
agagtgtctcaccccagctcctgggctcgactggtgcctctgaggagcgtacctgctgtt
ggaattggcggagcgctgccaggctgaggagcgaggagagcctgcccctgggccctgcca
ccaaagccatggggcagtcgcatgctttgcttgtcagttggtggcatttaggtggcatt
aggaatgtttgttgtttctaattatttgtttgtttgtttgttatttgaaagtaatccct
cttttccaaggcctgcatgctgccttgattctggaggagccaggggattggcccaatga
cccaaatgtttggaagtctttaagggccttttcatgcccgtgaagtcacagaagtaggt
aatcacccacctaccctccccaggtacccgatatngatgt >IGR3469a
attatttgtttgtttgtttgtttatttgaaagtaatccctctttttccaaaggcctgcat
gctgccttgattctggaggagccaggggattggcccaatgacccaaatgtttggaagtctt
taagggccttttcatgcccgtgaagtcacagaagtaggtaatcacccacctaccctccc
caggtacccgatatngatgtgggtcagagggggctgagaaataactcagcctcaaagcct
tagaccgtcttctcagggtntaaccgtcatctcaggatagacaattcaggaagaggatgc
cttgccacacatgaggangtgggagtggcaaatgagcaggcgttgcattcagggcaggtt
tagaggaaggtttggcaggtgaatgatggtttgcgtacaaactacagacaagaaattgag
aggacaactgggtataggtgaggtgactactctgccctcagaaaagtggaagtctgagtt
catgggggaatgcctcttaaataacacagatgggcaaactccagacattagtgaaacctt
cttcgttagacattcttttcagggtttctcatacttccccaatcaccttaatcatcagt
gctgaccacaactgatacctttctgggtgactcaaggccagtgctcaggcgggccaccgt
gtgttgaatccagctgaagatgcaggtgcagctggaggaa >IGR3470a
ataacacagatgggcaaactccagacattagtgaaaccttcttcgttagacattcttttc
aggggtttctcatacttccccaatcaccttaatcatcagtgctgaccacaactgatacct
ttctgggtgactcaaggccagtgctcaggcgggccaccgtgtgttgaatccagctgaaga
tgcaggtgcagctggaggaaggactagccctgaatgggcaccaaccccaaaagaatccac
tgactgtcacttaggcaaaagttccgcagtcacattgcttttggatcctccgcctcactc
ttcctgagaggtatttggtgcaaatagccggacctctggagtgggagacacctgactcca
gttcctgccacttcctccttcctgctagttgccagaccttggacagtttggtaactttga
atttgccctgtcaaattnattcatttactcatgcactcactcactcattcactcaacat
aaattcctgagtagcttccatgtgccaggtactagtttaggtacttgggagtgatcagta
gaggaaataggtaagtgttccgccttcagaaatgtgtatcatggcatgggaggtacaaaa
taagcaacaaagctgttaacaagttagaaagtggtaagtgctatgggaaaaaacagagca
agataagcagtgcttggagtggtggtagaagggggctgcaa >IGR3471a
tgtgccaggtactagtttaggtacttgggagtgatcagtagaggaaataggtaagtgttc
cgccttcagaaatgtgtatcatggcatggggaggtacaaaataagcaacaaagctgttaac
aagttagaaagtggtaagtgctatgggaaaaaacagagcaagataagcagtgcttggagt
ggtggtagaagggggctgcaatcttaaacagtatggacatggcagatctctgagaaaataa
catctgagcaaagacttgaaggtgttgaaggcgttagcccctttaggcacagggaagag
ccagcgcaaaggctctgaggctggtgtgttcaaggagcaacatggaggcaagtgtggctg
gagcagaatgagtgagcagagaggtcacaggggaaaagaaagtgatggaaagataaagg
ggaagatgatgcggaccttgcaggccactgtgggaactatggcttttctgtggtaaaaca
cagaactccaagaggttttgaacagagggctatgatctgactagagcataacaggatca
ctctggctgctgagttgagaatagattatagagcagggaacaggtagaagcagggaaatt
agctaggcttccactgaagtatattctagaagataatagtggctggaatcatcatggatt
cagtggaagtggggagaaatgagaaatgttggattctgga >IGR3472a
gaacagagggctatgatctgactagagcataacaggatcactctggctgctgagttgaga
atagattatagagcagggaacaggtagaagcagggaaattagctaggcttccactgaagt
atattctagaagataatagtggctggaatcatcatggattcagtggaagtggggagaaat
gagaaatgttggattctggacctgttttgaagaagaatcatcagcatttgctgatggct
tagatgttgagtatgagagagagatcagagttaaggatgactccaagggttttctctga
gcagctggaaagaaggattttgacctcaactgagacaagaagactatatgtggggcaggca
tgaagggaagattaggagttcactttagcacacataaaatgggataattatacttcaca
ggctgtagtgagggttaaatatgataatatatgaaaggtcttagtactagcaagctctta TABLE 5-continued gtaaatgtcactttcccttttctttctcaaagaggtggtgaagcatgaacagctggggt
ccccaaaccaatttgactaattgcctttctgtagaagtaatgtgccaatcagatgccaag
acagcctcctccctgtggttttctcactcttcaggaaactttcactgttgctaacagggt
ctttagatttgtcaaaggtttctcggtgatgttgacacac >IGR3473a
ttctttctcaaagaggtggtgaagcatgaacagctggggtccccaaaccaatttgactaa
ttgcctttctgtagaagtaatgtgccaatcagatgccaagacagcctcctccctgtggtt
ttctcactcttcaggaaactttcactgttgctaacagggtctttagatttgtcaaaggtt
tctcggtgatgttgacacactgatgtgatgatgagtttctgcatcagggcactgtggcg
cccagacagcctccatctatgtgctcaccgtttccatatcagtcactctgctggtgtcac
atgagcaagaggcatgatctcttcagcagaacagttttggttctacagacacacaccgaca
tccatatcactccttgtcccccccaccccccaggttgttatgggactgttgaaaaattactt
acctgtgaggtaggtactattattcccattttatagatgaagaacaaaggttcagagagg
cttgttatatgaattaagtgaatgagtatatgcaaaaatgcttagtaccactgtgcctag
aacttagtaaatgcttgagaaaggttaaccattgttaataaatgttaatcattgtcagta
gttcaagaaaggaaggattttctccaaaactacacttttgttataaaagacagtaggctg
acttaacattaggtcacaactttatcttagctatttgaat >IGR3474a
aatgagtatatgcaaaaatgcttagtaccactgtgcctagaacttagtaaatgcttgaga
aaggttaaccattgttaataaatgttaatcattgtcagtagttcaagaaaggaaggatttt
tctccaaaactacacttttgttataaaagacagtaggctgacttaacattaggtcacaac
tttatcttagctatttgaatcatttgattctgaataatattgttggcatgtggcacatta
caattttaaatgaacaaaacaaaaaaggtttatagtctgtatagtagaagcattttcata
cagggaataattggatatacttgactttatggatgagaaaatccaggtacctggaaggat
gctacccaagggccatctttggatatgggatgctcttacttgtttgaatttttaacagt
aaacttaaatcattcttaggacaataggctagtttgtaaagatgtctctgaaatgtccgg
taagatttgtgtggtacctgtgtgattaactgttttcagtggttacattgctttatctga
ggggccacctgactgtgctgacaccatgatggacagcccaagtcagggtgcatgagatag
tgaggcctagcaaaacagattccttagaagtgcccaaacttccctcttcagctgaggttg
gtgactgctcagacccagagccgtgcacatgcttagtcat >IGR3475a
tgtgattaactgttttcagtggttacattgctttatctgaggggccacctgactgtgctg
acaccatgatggacagcccaagtcagggtgcatgagatagtgaggcctagcaaaacagat
tccttagaagtgcccaaacttccctcttcagctgaggttggtgactgctcagacccagag
ccgtgcacatgcttagtcatttgatcactgtctgagaaagccttctctctgggtagaaac
gtaagaacaacttgaggtttgtagtatccctctcaagcttgtccaatccacggcctgtgg
gccacatgcggcccaggacagctttgaatgtggcccaacacaaattcataaactttctta
aaatattatgagacttttttctttaagctcatcagctatcattagtgtattttatgtgt
ggcccaagacaattcttcttccattggggcctggggaagccaaaagattggacacccctg
ctctatacactggttggtggtgagtgagggctcaggtaaacatgagacatctttgacagc
ttcaggataacaaaatctctaggtccagaagttctacttgcaggcctcctgtagaactgg
catatatgagaacaggaatctcatctttattctgtttaaatcctggagatttgattcatg
gcacctgccagtgtggacatttgcatgtgaatctcagata >IGR3476a
tgagtgagggctcaggtaaacatgagacatctttgacagcttcaggataacaaaatctct
aggtccagaagttctacttgcaggcctcctgtagaactggcatatatgagaacaggaatc
tcatctttattctgtttaaatcctggagatttgattcatggcacctgccagtgtggacat
ttgcatgtgaatctcagatacactggcttcattagcctgtaaaacagttcaagagacagg
ccaagttcccaaatggtctctcaagaaagctataaaattgtgcagaagcaaaacatttga
gtacctgcctttcagccatgatgttttctatattggaagcctagtatcatcctgattcaa
catttttcctgggctcattcttagagtccagggcagcccagtttgaaaatggcataattct
catactctctgaccattggggtcccactaccgggtaccaaactgtgaggggtatattac
tggatgtgtcacagacatccaccctgccccacaccactgagatttgctgattggagtgac
tttaatggataaattctgccccaacactgaatgctcacacaaggcccttgactcttccct
ggtattcccatttatgcttcaattgtccttgcttccatttctgccccctcaccttggca
tccccagccctctgctttgatatctttgtggcttggatgc >IGR3477a
accctgccccacaccactgagatttgctgattggagtgactttaatggataaattctgcc
ccaacactgaatgctcacacaaggcccttgactcttccctggtattcccatttatgcttc
aattgtccttgcttccatttctgccccctcaccttggcatccccagccctctgctttga
tatctttgtggcttggatgctgagtggagaggagagctctctttggtggtgagcaggaga
tgactagtggacctctgatgacaattgactctctctcctcctggcagccgccttccctcg
gctctaccactaccactgttcaaacattgctctctgctctcccatggccaggagctcaa
aagctgctacagaccaggaggattccagcttggacacccttatgaccaatgagctacaact
tcagtgggcatcatctgggcatcagcttggattatgaccaggtcaagttgctgagtgcca
ggcagtcaacaagcaactgctgtggcgtccacctgtcaaagttctgttcagttcaagatgc
aagagcaccaggttgaagggcacttgctgcatgtcaagttcagttctttttatgattaga
gtcagagttccctgcaagtgagaacagagcccagctagacctggccccagggctcccttg
ctgtctgttccctcttccttctggatacttctggccctgt >IGR3478a
tgtggcgtccacctgtcaaagttctgtcagttcaagatgcaagagcaccaggttgaaggg
cacttgctgcatgtcaagttcagttctttttatgattagagtcagagttccctgcaagtg
agaacagagcccagctagacctggccccagggctcccttgctgtctgttccctcttcctt TABLE 5-continued ctggatacttctggccctgtcccagggcatttgacaggggcctccaagtacctaggccaa
ctgaggagcagaggtagaggtgttgaaaagcctccacctgccaagaccttgagcactgaa
cccaggcagcctcctgtgcccagcctctgtcctctattcctttgtgagcccttctttga
ccacttctccccttttttaccctcactctccagttcaggccatcaactctggcgaagcaa
atataaaaaccttctcactgatcccccttactgacttttggccagcacagtagcctgaggg
atcctttaaaaacataaatccagctccttcttgtcagtcaggtctcagccaaatgtcacc
ttctcagaaaggctcccattgaccatctanaatcttccatgccatcatcacatattctat
ttattttatttttattttaaaaataggtttaaagggcacaagtgtggttttgttacatgg
atatattatgtagtggtgaagtctgggctttcagtgtagc >IGR3479a
cagctccttcttgtcagtcaggtctcagccaaatgtcaccttctcagaaaggctcccatt
gaccatctanaatcttccatgccatcatcacatattctatttattttatttttattttaa
aaataggtttaaagggcacaagtgtggttttgttacatggatatattatgtagtggtgaa
gtctgggctttcagtgtagccatcacctgaatagtgaacatcgtacccaataggtaattt
ttcaaccctcactccctcccatcttttgaagtctccaatgcctgttattccactctgtat
tttattttattatctccactgacattatcttgagcattcttttgtttactgctttactgt
cttctttactaccttgtaagcatcaagagggcagacaatttgtcccgcatngccctaatg
cccaggacagtgcctgataacatggtaaattggtactcaaaaagtatttattgaatgaat
gaatgaatgaatgaatnnnnccattcttaagaagagctcacattgccagtcactgg
gctgtcaagcagtcctcaggctgacttgagtgctgagtggagaggagagcctctccttgt
ggcgagcaaggcatgagcctgccataaccccaggagttacggggcaaggcctcttggcct
agtggatgccagccagtaggccacgggtctctttaaaagc >IGR3480a
nnnnccattcttaagaagagctcacattgccagtcactgggctgtcaagcagtcctcagg
ctgacttgagtgctgagtggagaggagagcctctccttgtggcgagcaaggcatgagcct
gccataaccccaggagttacggggcaaggcctcttggcctagtggatgccagccagtagg
ccacgggtctctttaaaagcaacaggaagccaagtcctggagataagaagtgtggctgcc
agcgtgatagaggtgggaagagggctgaagggtggagaggtgggggctgccgggcacctc
tgtgctgctccctggggatgcccagacctctgtggctggctggccagcaccacatgcttc
ctgtggagagcaaggagaggagatcccctccaaaggccctggagctgggactgccccagc
agcctcaccctt gtcctcactgtggttaagacgcagggctactgtcccacttctctg
ccattcatggacactagggcagctgccatagggcaagtgtcatatccatgtgctctctgc
acctggctccctgtgcttctctgtgttttagactcttcattggtacaatggattcctcca
cactggtgattgtgaagagtctgggaagtctggggaggaactggggactgggggctagagt
ctcaaggaggagtgagggtctggagggctgagatactaga >IGR3481a
agctgccatagggcaagtgtcatatccatgtgctctctgcacctggctccctgtgcttct
ctgtgttttagactcttcattggtacaatggattcctccacactggtgattgtgaagagt
ctgggaagtctggggaggaactggggactgggggctagagtctcaaggaggagtgagggtc
tggagggctgagatactagatatgagaggcagcccgggtgtggtggatgggctggcaggg
gctagctagcatttggatgcaacataacaaagacctggcatcccttcagtgtctcatcc
cggctggttgatgccaagtagcaggaagagtgatgaaagggcacctgaggagactcagag
actttggtttaagtgttgtatctgccactgtctggcagacaagtcgtttctctgctcaca
gcttcagtgatgcgtctgtgaaacgggtcatgttctctctctcacatgatcgtggtgagc
attaaggaaattatgtaaatcatttcagtgactcttcaggcttcngctcccattcctgc
tggggtcatctcctaggatagtgaggatgtctgtggacacaaactaaggaagccagaaaa
ccgctgtcctgactcagtgtcttgccccaccctggcctctggcccagattctggaggcct
tagtcaggggtgggggtctgtttgcccagagctggggtt >IGR3482a
catttcagtgactcttcaggcttcngctcccattcctgctggggtcatctcctaggata
gtgaggatgtctgtggacacaaactaaggaagccagaaaaccgctgtcctgactcagtgt
cttgccccaccctggcctctggcccagattctggaggccttagtcaggggtgggggtct
gtttgcccagagctggggtttccctatagatcctgtgggacagaacaagtgcagcccact
ggaaagcccttgaaacagttggatgtcaccctgtctgagaggagcttaaagctgccagaa
cggactggtggactggttggatccgcccccttgggaaaatccaggcatgagctgtcacct
ggacctgagtacagttcctgtccatcctgcactagcgaggccatgggaatgctcagaag
gggaggcgtcgcgtgaaacctgcttaatatacagcctgtccaaaggtcccagcccccagc
cacctgaactgccaggactgttccatttccctatcctccacaggcctgcccgaggcccc
tgncaacaaatgtcacttccccacaccaacctgcttcctccaggattggtattttctgac
ttctatgttttcatgcttctttgatgccaccgctcctgtttctctttctcctctgtga
ccagttcttacaagcctcttacacagctgcctcctcctct >IGR3483a
ttccatttccctatcctccacaggcctgccccgagcccctgncaacaaatgtcacttcc
ccacaccaacctgcttcctccaggattggtattttctgacttctatgttttcatggctt
ctttgatgccaccgctcctgtttctctttctcctctgtgaccagttcttacaagcctctt
acacagctgcctcctctctgcccatcttctaggtttccaagttccttggggcttggtac
ttctctctttggctaccctacaggtctcaaacttgcggtctaaaggccaaatcaaggtct
gcaccctccaacaagggtccctaccttttcttaacctgccacctacaaacaacacttca
gactagtggtgttcccagacatgtttctgcatgcccctctttggggagaaactccacgat
tatggagccatcctaaatgcgagctactaggtccagatttctttgatctagcttcagcct
atccccaccacacctcttaccagatcacctggcctggttgaaggctttctttaaggcat
cccatcacaagcatgtttttctctgccccctttgccacctggcaaacgactcctcctctttt
tcatagactgaccaagaaactatagccgccccaacccagatgactgattctgctcact
actgctagggacaaaagctgcctgacaggtgtctctgata TABLE 5-continued >IGR3484a
cagatcacctggcctggttgaagggctttctttaaggcatcccatcacaagcatgttttt
ctctgcccctttgccacctggcaaacgactcctcctcttttcatagactgaccaagaaac
tatagccgccccaacccagatgatactgattctgctcactactgctagggacaaaagctg
cctgacaggtgtctctgatacctggtggctgagatacagtgagtactcaatattagatgg
ggagagggaccctgtagccatttctcctgaggagttgagtacctgagaatggcagagtga
ggctcttccctgggcttatgtgtcacaataggaaagcaacagaatcccagttgccaggqt
tgtggggggaagcgtggtttgtaagcatcaggctctgacccatctgcccagggacaagat
ttgtacaggcttttaaggtggtcttgtggatgctgtgatacacagctcagacccccctg
cccatccccttttatgaatgaaagatttatttccaccagctggtgggagagctgccagaag
acagccccagctgtcagccctatttttggactactgctaaaaaataattgccttgtgtaag
gtcacacctacttctgtagggagcccacgtctaccaactgataaatatgaaggtataaag
gcttggctccctctccttcttgggaaaactctgaaggatc >IGR3485a
aaagatttatttccaccagctggtgggagagctgccagaagacagccccagctgtcagccc
tattttggactactgctaaaaaataattgccttgtgtaaggtcacacctacttctgtagg
gagcccacgtctaccaactgataaatatgaaggtataaaggcttggctccctctccttct
gggaaaactctgaaggatcatcacagatgagcactcctggtctcagctggaacctcggc
tggaattgcatagtagctccacttctccttttgcctagtcctgtttcagtcctcatttcc
actgatgttgacccaagatcttttcctaataaaggtcctacatgctcatatcctactca
gtctgtttcctatagaacctaatctatggcatctggctttaggagtgacagaaaaaaat
gagatgctaagatatgattttggagctggatcatccactgttggctgccaatgaggactc
ccatcacaggtggcaggtgaagcagacagcttttggcccatggtaataatgttaaaact
tttacctatgttggaagagaatgcattagatggtgcagtgcctcaggtgtttgagaaata
tgggggaattagccactgcaaggacaatggaattgctaagcttgactaactttcagtaaa
agaaaatggagagcttagagtgattaattggcaatgaaaa >IGR3486a
agcagacagcttttggcccatggtaataattgttaaaacttttacctatgttggaagaga
atgcattagatggtgcagtgcctcaggtgtttgagaaatatgggggaattagccactgca
aggacaatggaattgctaagcttgactaactttcagtaaagaaatggagagcttagag
tgattaattggcaatgaaaacataagcatgaaagccgtaggcctcttggtgcatctata
gaaaagaagaaaaagcagagaatcagacccagacttctgtcaaagtagttaagcttcaaa
gaaggttatattcccaaccaaggcaggtcttctatgccaagggcagagccctggttgggg
aagaatgagaccctgacacgtgggatgaggacctctgttgcacctgaatatcttgaatcc
tcagatttcactaaacactctggacctgcagaagtgacctactcatctctgttaaaagct
agaacttgcttcttactttaaaaagaaantgcggaggcttctgtcctgcaagacatgctc
tcattccatgttacctctttgtgctaggccaataactagggttaagtcaaaacctaacct
ggccagacatgctgaacttgctagtgtagaaaaggactatacctcaaaggaaattctggt
catatccagagagtactagcaggagcttggagagtatgca >IGR3487a
aaaagaaaatgcggaggcttctgtcctgcaagacatgctctcattccatgttacctcttt
gtgctaggccaataactagggttaagtcaaaacctaacctggccagacatgctgaacttg
ctagtgtagaaaaggactatacctcaaaggaaattctggtcatatccagagagtactagc
aggagcttggagagtatgcacaggactggattctggaccaaggggtggaacagaaattt
gaacaaaagagtttatggatatgggaacattcttccaggataaagtatttaaaactgtgg
caaggccccaagagatggtgcaaatacatcgtttggatggctcctagaagcatggaaaga
ggatggcccatattaagtgagggtagccagaatggctatggcagactatgaaggacgtgg
gtgtgcaggaataaatatactaagcaaattcagaatactcgcctgagggccaagaagata
ccaaaacaagaaatgtattggaagaagggcaccagtatcaccaagaactaaaatggtgg
ctaaaataggccagcattgataggaaatgtcacagaactgggctcactgatagcagtagg
ggtgataggactctgagataatagaggccaagtcatagcacttggcccagttgtctgggt
ggcaagattggaatggctgttaagagggcctggctcccgg >IGR3488a
gaaagaagggcaccagtatcaccaagaactaaaatggtggctaaaataggccagcattga
taggaaatgtcacagaactgggctcactgatagcagtaggggtgataggactctgagata
atagaggccaagtcatagcacttggcccagttgtctgggtggcaagattggaatggctgt
taagagggcctggctcccggggagttatggacatggttaataaaacatagcatctggagg
gtcacaatagatggccagccaacagtgctgcgggttattctgtcaagaaaaagaaatca
atcatgcgataatgagtccagtcaccccaataaaaagtaacctgccgagtttccagatctg
aaccagttttcagacttagaacctactgattgaagaagatgccagatctcccagaaggaa
gagtcccacaccaccacagcaagtgtgcatgataatgatttccccagcccttcccaggg
ggacctgtgggcacttaacctggatagctacatactaggaaagagaatatcctaacatgt
gaaagactattgaacccgggattagaattgacattgttacctaggtacctgaagtggcac
caaaatcctctcattagaatgaggggtatatgtgggccaggtgatagattcctggcctga
gttctgctaatagcaggtcctctgggtccacagacccaca >IGR3489a
tggatagctacatactaggaaagagaatatcctaacatgtgaaagactattgaacccggg
attagaattgacattgttacctaggtacctgaagtggcaccaaaatcctctcattagaat
gaggggtatatgtgggccaggtgatagattcctggcctgagttctgctaatagcaggtcc
tctgggtccacagacccacagtgatataatcagatcaacacacttgataattagcacagc
ccctacattgggtccttggcctgcatggtgagagtgatcatagtgaagaaagccaagtgg
aagccttcaaaaccttcccattccaggcaaaatagtaaatcaagaacaatatcacattcc
agggttaatggcagaaattattgccaccattatagacctaaaaggagtccgtcatatct TABLE 5-continued tcatttaatttaccagcaaaacccagttaaatcctgaaagatgacagcaggctactacca
attcaacagtagcccatttgcagccactgtgcttgccaaatgtgtcttcactacaacag
attaacatgggctcaggcatacagtgtgtagctgctgatttggtgaatccattcttttcc
accctgttagaaattgtttgcattcacttgggacaaacaacagttcaaatttccaaggc
aaagttaactctcctgccctctgtcataacatagttccaa >IGR3490a
gcagccactgtgcttgccaaatgtgtcttcactacaacagattaacatgggctcaggcat
acagtgtgtagctgctgatttggtgaatccattcttttccaccctgttagaaattgttt
gcattcacttgggacaaacaacagttcaaatttccaaggcaaagttaactctcctgccct
ctgtcataacatagttccaagaagtctgaaccacttgggcatcctgcagaacatcacact
ggtctactctattgataatattatgccagtcagacaagattgatggccatggcaagacac
atgcactccagaagataaaccctatgaatattcacgcctgccacatcagtgaagttttt
aggaatccagtagtctggagcgtgcagaaaattcccaccaaagtataggacaaatcacta
tgtcttgtacttccaccatgaagaaggaagcggaatgtttggcaggcctcttagggtta
tggatgcaacctatatggatgaaacctattacacacttgggaatattattctgaaccata
tacctggcagtgacacaaaagcctgccatctttgagtgggccccaggcaggaaagggct
ctttggctgtagtacatgtagccctgccatgtgggccatatgagtcatcagatactgtgg
ttttaaaggtatctgtactgggaaaatacactgtccctag >IGR3491a
gaaacctattacacacttgggaatattattctgaaccatatacctggcagtgacacaaaa
gcctgccatctttgagtgggccccaggcaggaaagggctctttggctgtagtacatgta
gccctgccatgtgggccatatgagtcatcagatactgtggttttaaaggtatctgtactg
ggaaaatacactgtccctaggtctggaacaaggccataccatctgccactggagaatta
cataccttttgaaaaacagctgtgccatgcttctgagccttggtaggcctggagggcctg
actcagtgaccatgcagcaagaaccaccatgatgaattggtttttgtgagacctactaag
ccataaggtcaggtgggctcaacagcaatccatcataagatggaagtggtacaactctaa
ccaatgagcaggattggaagacacaaataagctgcaggtgcaagtgacccagaaccctgt
accatccaactccaggacaccaaaaccttcccccagctcacatctatggctgcatgggtg
atcccttgtgtccagctgatggaggatgtaaaagctcaaacttgattcccaaataagttc
agatacaatactcggcctcaggagatcaagagaccaccccactgctaggtgactacatt
agccctcttatacccctgaagggccagtgattcattttga >IGR3492a
caaaaccttcccccagctcacatctatggctgcatgggtgatcccttgtgtccagctgat
ggaggatgtaaaagctcaaacttgattcccaaataagttcagatacaatactcggcctca
gggagatcaagagaccaccccactgctaggtgactacattagccctcttatacccctgaa
gggccagtgattcattttgacaagaataaagacacaatttaagcatgaggttgccttttcc
tggctgcagggccacagccaacatcactatccaagggccttcagagttttttattcccctg
gtatgggatctcacatagcatatcagactgagggatctactttatatcaaagaaagtgga
agcacaggtccatgaccataggatgtgctagtcatatcacatattgcaccactcaggtgt
tgtcagtttggtagagtgttgggcaacagcctgttgatggcatagttgaagcaccggctt
gggggtgctactttacaggataatgaactattcttcaggatgcagttctcactataaatca
aagacccttatatggagctctgttccaataggtataatacaagagtttcagaaccaagaga
taaaaacaggagtggcccccttactatcattcccagtggcccacttggaaaatatatgc
ctcccatccctgcaaatctgggctctgtgggtttggagat >IGR3493a
aatgaactattcttcaggatgcagttctcactataaatcaaagacccttatatggagctct
gttccaataggtataatacaagagtttcagaaccaagagataaaaacaggagtggccccc
tttactatcattcccagtggcccacttggaaaatatatgcctcccatccctgcaaatctg
ggctctgtgggtttggagatcctggttccccaggagggaacatttccagcaaaagtccca
ttagactatcagctagggatgctgccagggcacttcagcctttcttgtctagggacaag
caggaaagaaaaggaggtaccatcttggcaggggtacctgagcctgatcatcaggaggag
gtaagactacacagtggaggcaggaggcatacatgtagcacccggtgatccagttgga
tacctctttattactcccttttccaattttgacagtaaatggacaagtgcaacaatccca
gcctgagatggaatcagacctcttagagatgaaggattgggtcatgctaccaggtgagcc
agcaggatgagcaaaggtgctaactgagagtgagggggaatctggaatggatagtagagg
aggagatgatgagtgtcatttgtggccctgagatcaactgcaacagcagggactgtagtt
cattgtgaaccttcctcttctaagtctcccagaagtagaa >IGR3494a
tcttagagatgaaggattgggtcatgctaccaggtgagccagcaggatgagcaaaggtgc
taactgagagtgagggggaatctggaatggatagtagaggaggagatgatgagtgtcatt
tgtggccctgagatcaactgcaacagcagggactgtagttcattgtgaaccttcctcttc
taagtctcccagaagtagaagcctgctggaaccattggtgtgctagagctggctacttgc
tcgtgagatcccattgctaaagttgttgccagtctgttttaaaccgttggtagtgcacc
gatggtgggagtatttataccatgatagtttttttttctcttttttttttttttggagaa
ccagttattgatagcacaccactggaatcctggaggagctgctcccagaaccagtgggaa
gtgttatatgaagaagtggatccagaaagctcaagggatggactatggtggaagctatg
atatgctgccctgaacacccttcaggagtcaaggtctgattgcccctgctgaagaaaatt
tccgtgcctaaggtcatgcttcttccaggggcagcttacatccaattactgatcaaaat
gaaggcataaaggcttgacctccttgccccaacataggaagagtctgaagggccatccca
gctgtagaagtctccttaggatcagctgagactttttgttg >IGR3495a
ttcaggagtcaaggtctgattgcccctgctgaagaaaatttccgtgcctaaggtcatgct
tccttccaggggcagcttacatccaattactgatcaaaatgaaggcataaaggcttgacc TABLE 5-continued tccttgccccaacataggaagagtctgaagggccatcccagctgtagaagtctccttagg
atcagctgagacttttgttgtgactgtattttgtccaaattctccctctgttcaatcctg
cttccttcccttccttccatgagcagtcctgcatgccagtttctgtctcagagtctgct
tcccagggaacccaacctcaggcaggcagcctcgtcatgctttcaggcacaacggtcccct
gaaagtagaaaaacctcagctcacccagggggttcttggaccctacagcctcagagca
gagtgtgttcaagtcagcttcagtctctgcagctatgaaggggactaatcacccatcct
cacctggcctggaattgctccctgggtcaaaaccttttaggccctcaggcctctggggc
ctggaggtcatgagggtggtgagaagagaaggcggccaggtggagctcaacatcctcgg
atagtcgtgcaaatgccggactatagcctcttctgggcaccgcccctgtgccaacagag
tctggactcatagtggttcctaaaaggaccttttccacga >IGR3496a
ccctgggtcaaaaccttttaggccctcaggcctctggggcctggaggtcatgagggtgg
tgagaagagaaggcggccaggtggagctcaacatcctcggatagtcgtgcaaatgccgga
ctatagcctcttctgggcaccgcccctgtgccaacagagtctggactcatagtggttcc
taaaaggaccttttccacgacaagcacagccaccatgctgggagtaggtggccccaggag
agatgtcgaggaggctttctctgccccacaggccaggaaggggaggaaaaaaccaggaga
atggattgattcttgagtctgactccaggggacagtgagggccacagcctactaccttcct
gggacttgtggggttgagggcattgtagtcctggagaaatgggtcccaagagtcccacaa
agtctctgatcacagtgccaagaggaggaacctccaagagaatcgggatctgcagtcagg
ggctgagctcagagacagaatggccacattttaacctgaccacacagcttgcaactgcgtct
ctgtctgtccctgccagggctcttgccaagtccgccatctcctctatgtctgtcagtct
ttcactgccagcgttccctcttgtctctccatctgtcctttccaggctctcgctgagtct
aactgtctatcagtgtctgtccgtttactcatcactgcca >IGR3497a
tggccacattttaacctgaccacagcttgcaactgcgtctctgtctgtccctgccagggg
ctcttgccaagtccgccatctcctctatgtctgtcagtctttcactgccagcgttccctc
ttgtctctccatctgtcctttccaggctctcgctgagtctaactgtctatcagtgtctgt
ccgtttactcatcactgccaggagcctgagctatgcctatctgtttgtctgcccctgtca
tggtcctgctgtgtctgtctgtctgcttgtgactcctggtccttcagcctgacagagtct
aaggtcagatgctccttcctaacaggggggttcattgtaacttggggacctggtccttca
gcctgacagagtctaaggtcagatgccaccttcctaacaggggggttcattgtaacttggg
gacccaggcccacacccatttttgtttgatctcagagcccaaggctgcatatctctgtcc
ctcagcccataggcacaagaacctttggtgtgaccatgcccagggtatggctcgaggc
tctggcagcttcctcttatttccacctgggttccaacactggttgctgcccatgtccagg
actggattggtgagaggaggcattagggtctgtctgattcacagtgctgcccctagccct
gagaagagagagagcttccatttcagttgaggactaagag >IGR3498a
aacctttggtgtgaccatgcccagggtatggctcgaggctctggcagcttcctcttatt
tccacctgggttccaacactggttgctgcccatgtccaggactggattggtgagaggagg
cattagggtctgtctgattcacagtgctgcccctagccctgagaagagagagagcttcca
tttcagttgaggactaagaggcacccacagaatctgcccagagaggtcccagtgggaga
agggacctgaggggtatggagttcactcagggacagcttcctggagtgtaaggggagagg
ggagactatgagttatcctgttattgtgttgtttctgactggctccaacccagttgctgc
ttccctggcctcccttcccagcacatgacctcacccttatccagtctggtagaggaaga
ggcctggataggagccaggcctccatcaggagagcttggggctgcccaggcctaactg
gaggaagtgtgacacattcccagagagctgggcttccctccctcctgcagcttcctttga
gatggttcccgaatccgttaagtgggaaaaagagctggcagctgtgctggtgttgggctc
ccagttcccctggcctcctgatggccccaagggcctcctcttggctccctcacagatgct
atttttgataagaataatgaaaacaacagccctggctgtg >IGR3499a
cagagagctgggcttccctccctcctgcagcttcctttgagatggttcccgaatccgtta
agtgggaaaaagagctggcagctgtgctggtgttgggctcccagttcccctggctcctgg
atggccccaagggcctcctcttggctccctcacagatgctatttttgataagaataatga
aaacaacagccctggctgtgtacttagtacctgcttatagcctgttgctgatcttggtcc
caagaacattttctaaactttggaaaattggatgttgccttccatccggacttctgtaa
aagctgtgtgcatttcttttattcaaaggtgaaaagaggctcactttcatcagactctgg
aacatagtcactgctggcacttgatgccatgaggggccctcctccgagctgggggataaa
gcagtagttcagagcagagaccctcacagtcccctgaggaacagatgacagtccacccct
gtggcgtaagaggtgggcaggcaagcctcagagtaggtgttgaggaagaggaggccccag
tgcaggacctctccacctcccactggacattagtcttacccattgtggagacagatgtc
aaccatttggctggggtgcattccaggcaggggtagcaggtgatggtgggagtgctgtgg
ctggttcgtgttactgggtccagggctgatatgaaggag >IGR3500a
gcaagcctcagagtaggtgttgaggaagaggaggccccagtgcaggacctctccacctcc
cactggacattagtcttacccattgtggagacagatgtcaaccatttggctggggtgca
ttccaggcaggggtagcaggtgatggtgggagtgctgtggctggttcgtgttactgggt
ccagggctgatatgaaggagatggatggtgagcaatgaggctagaggtatctgcaggggc
tgacggggccagggcagtaagggagggtcttaggtcagaccaaagggcttggagttcatg
ctgagctggcaggtaacccttatgacacacagccagactaacccctaaagtgtaagctcc
tcaagggttggtttcctttcagagcctggcacagttcctgacactttgtaggtgctcagt
acatatttatgtaatgaattaatgggtggctgctgtggggagagaagcaggaagggtcta
gagacaaggcctgtgggtatttggggtgattgtctgcattagtgaggtggactgggtcag TABLE 5-continued ggcaaagccataaagacaaagagaagtgggcaggttggaaagggctgggaagatgaatg
taccaggacatggcaggggactgactaagggaccgagacctcaagaggaacccaggacag
tacccaggtctctccacttggtttctccacataggatagc >IGR3501a
ttggggtgattgtctgcattagtgaggtggactggtcagggcaaagccataaagacaaa
gagaagtgggcaggttggaaagggctgggaagatgaatgtaccaggacatggcagggga
ctgactaagggaccgagacctcaagaggaacccaggacagtacccaggtctctccacttg
gtttctccacataggatagcaaaacattacagtttacctggagcctcccagaggctctga
gaccttgtagataagggctgcactccacagtgtgctggcaagacaccatccacagccaca
tcaaactgggccctttgtgagctacctctcccaaaaggagatgcaggagtaaacaacgc
agagaagaatttctggtaatgatgggagcatttgggaagcaggctcagatcatatgaaag
aagaagagagttccagtgtctggtggataagcagtgtctacaaaaggcaggaaaaccaac
agcaacattgttcatgaaagactttttttttttttttgagatggagtctcgctctgtcac
ccaggctggaatgcagtggtgctttctcggctcactgcaagcttcatctcctgggttcaa
gcgattctcctgcctcagcctcccaagcagctgggactacaggcatgtgccaccatgcc
cggctaattttttttctatctttagtagagacagggtttca >IGR3502a
acttttttttttttttgagatggagtctcgctctgtcacccaggctggaatgcagtggt
gctttctcggctcactgcaagcttcatctcctgggttcaagcgattctcctgcctcagcc
tcccaagcagctgggactacaggcatgtgccaccatgcccggctaattttttttctatct
ttagtagagacagggtttcaccgtgttagccaggatggtctcgatctcctgaccttgtga
tccgcctgcctcggcctcccaaagtgctgggattacaggcatgagccactgtgcccggcc
aatgaaagacttttccttgggaaaatattaaatatttgccagcagctaaagctagtattt
agttaaagctaaaatatgtatgtcctatgacctagcaattccatgtcattcccagcattt
ccagaagaaaggtaaacatatgctcaccaaaacatgagtgcaggaatattcagtgaagct
ttattaatattagcccaaagtggaaacaccccaaatgtctgtcagcagtagaataggaa
atttttttttaattaaaaaaatttttttttagagacaggttctcactcggttgctcaggct
agagtgcagtggcataatcacagctcaccttagccttgaactgccgggctaaagcagtcc
tcctgcctcagccttccacgtagccaggactacaggcctg >IGR3503a
gtggaaacaccccaaatgtctgtcagcagtagaataggaaatttttttttaattaaaaaa
atttttttttagagacaggttctcactcggttgctcaggctagagtgcagtggcataatca
cagctcaccttagccttgaactgccgggctaaagcagtcctcctgcctcagccttccacg
tagccaggactacaggcctgcgccaccaggtccagctaattgttttattttttttgtggag
atgaggtcttgctgtgttgaccaactggtctcaaactcctggcctcaggcagtcctcctt
cctcagcctcccaaagtactgggattacaggcatgagccactgcacctggccagaatagg
gaaataaattttaggatatttttataatgggatattatacagcagtgaaaaataacgtta
caatgatgggcaataactagagaattacacagacacagcgttgaatgaaagaagtcaatc
ataaaagggtatagtcatgcttctgttctaaatgaagttcaagaatgggcaaaactaat
ttatggtggcagaggttggaatagtggctatacttggagggaggatactgattaggagca
gggaagtacaaggaaggctttggtggtagtggaaaatggtgtatgtgtttccctgggtgc
cagttatttatataggtataaatataaaaactcactgaac >IGR3504a
cttctgttctaaatgaagttcaagaatgggcaaaactaatttatggtggcagaggttgga
atagtggctatacttggagggaggatactgattaggagcagggaagtacaaggaaggctt
tggtggtagtggaaaatggtgtatgtgtttccctgggtgccagttatttatataggtata
aatataaaaactcactgaacgatatacttaagatttgtgcacttcatttgtacaatattg
caataaaaatgaaaataacttttttaaaaggtttttctccacctacacaagaactgcaggc
ttttgaaggaagtgctgaacttccaggtggtatgttaacggaagggcctgggaagttcgt
gctgatcttcccttgaggttgaccaaaaaagggagaaagattttaattaatcatctctc
aggttgaaagagcaggtctgggccagagataacatcagcagcaccaacatgaaactgttt
cgctgctcttttcttaaaccacagtgaaaaataacttttgaagttgcatttttcctggca
gtcatggtgcagggtcccctcacagaagggaaattggtcaactgtttccaagagtgaggc
ctgtgtccagcagcccttagaggacccagagaggggtttctgtggggccaggctcaac
aattctgtctagcttacctcctgtgtggtcctgaggaagt >IGR3505a
acagtgaaaaataacttttgaagttgcattttcctggcagtcatggtgcagggtccct
cacagaagggaaattggtcaactgtttccaagagtgaggcctgtgtccagcagcccttta
gaggacccagagaggggtttctgtggggccaggctcaacaattctgtctagcttacctc
ctgtgtggtcctgaggaagtccctgccctctctgggccttggggctggggagcttccagc
actgacagtaggtgagatggctgctcatcaccccagctcccatcttgggggctgcccct
gttttgacttgctctgcagactgcatgccatgagtgtctggcctccccaccccctctgagg
aacagggcacgcatcagggtgttctcagcagcaacaggttttcccgactctgcatctgcc
tggtcttaatggtgtcagggcaagctggtcttgggctggggtcttttccatttctgcctca
ccctacttcacagataagaaaacaggccagagagggacccacgcatcacatttcttgtg
aagcccatgtaacaaagtgggaggatccacggcaggagccgctgggtccagggacaccag
ccatgtgccttcagcacaaaccagcagcgggctcagaagcctgggacagcacagtgtggt
gcctgcagccctgccctccacttcaattatgcagaccca >IGR3506a
aaacaggccagagagggacccacgcatcacatttcttgtgaagcccatgtaacaaagtgg
gaggatccacggcaggagccgctgggtccagggacaccagccatgtgccttcagcacaaa
ccagcagcgggctcagaagcctgggacagcacagtgtggtgcctgcagccctgccctcc
acttcaattatgcagacccagcttaccaagcacatacatatgcaggcagccaggaaccag TABLE 5-continued gagtaaagtctccagaacatagcacatctgattaccagggccagtcctgtccatttgggg
ctggcgtggtgcaggccaaatgggtagcccctatctgtgactccatgcacagggcatta
acgtgtgaggttaactgaggatgtgtggacagcacttgcaccctctcaggccatgctgtg
agctgttctgcctgtccgggaggagcagacaggcctcttctgctgtctgtgctgaaagag
gcaccttggctcttgcccaggcaggaatgctgtgggcctttgagggaacctgcctcattg
taagctaatcaagatgttcagcatcttggccgaacagccaacttgtggaatcagttgaca
caaggacaccacagagaatctcatttagccagggacactgaggatggaaattttctataa
gcacggggaccacgtgatggccgctgacctgggcactgag >IGR3507a
gcaggaatgctgtgggcctttgagggaacctgcctcattgtaagctaatcaagatgttca
gcatcttggccgaacagccaacttgtggaatcagttgacacaaggacaccacagagaatc
tcatttagccagggacactgaggatggaaattttctataagcacggggaccacgtgatgg
ccgctgacctgggcactgagcccctctcttcagatcaagccatagggaaaagctcatctg
ccatcccacctcccaagtcatcatcccaattcccttccagtccctggcccacatggggtt
atcctggcagccacgccatactggaccttcaggatgccttccacgttgccctgttag
tttcatgcccatcatttcatctcacagactgacagattggccatttccatggatgaagct
tccctccttatgtgtggtctctctgggtatgaatgccaagtcaaaggatgtggccatact
atgactgtgacagagactgctgtgggctgctggttctcaaggcccagcatatgagagag
ggctgccctgctgccttagcgtatttcttagatttctggttccagcctcaatgctactga
tttctgtagtgggagagagtacagaggacacggagggtggtagagagtagaggtggtcct
tgggaggcccatgtgaaaggaggggctatcccattgtctt >IGR3508a
tgtgggctgctggttctcaaggcccagcatatgagagagggctgccctgctgccttagc
gtatttcttagatttctggttccagcctcaatgctactgatttctgtagtgggagagagt
acagaggacacggagggtggtagagagtagaggtggtccttgggaggcccatgtgaaagg
aggggctatcccattgtcttgagaggtcttgatgtgtgaatgaatcttctcaggccacca
agccctgctcttcctcccagtctagagcatttcctcagggcccggcctgctatagttgtc
tcctacggaagaatattgtttggacctatttcttggcctccttgggaaagggagtacccca
gggccagtcccagccaattgggagtcaagaccaagcttcttgggcccaggtatccagccc
agggctccaggaatccagcaggccagcatcttgagatcctgaagcagcaatgccagcagg
cttctggggagctgtgggctcaggcctgcctgagtctcaggtgcagtacccacatggcc
tcccacctggttccagcccccagcaggctccctagccccactgtccagatatgagtctac
ctgacggtagaacaagggcacatggaaaactcaggtggccgtcactgcagtctcttcatg
ggtagctgtttggtgactttgaccaagggttaaggctgtc >IGR3509a
caggcctgcctgagtctcaggtgcagtacccacatgccctcccacctggttccagcccc
cagcaggctccctagccccactgtccagatatgagtctacctgacggtagaacaagggca
catggaaaactcaggtggccgtcactgcagtctcttcatgggtagctgtttggtgacttt
gaccaagggttaaggctgtcagggtgatgagggcagtcacttggtttagtacagccagct
tcccaccagtgccccttccaacttccctgtttaccagaagaggtaccagaagctccctgt
caaccttctgacctcagtttccccagagttgagccagatgccctgaggtcctttcgctg
gataaaaaccgtggacctgagttctgatctggcctctggggctggagttcaccccacctt
tgccggactctgtggctgagagactgaagtacctgtcccaggtcacacaacaagctagtgg
caggccagtctcacatgtaccatgctgtgctgaacgtggcactgaggtgaaaaggacata
cgtctatgctccccaccccactgtcaggtacctcaggctttgtcaggagctcaaggtca
ggagacctcatgcctggaggaggtctggggcaggaagaggaggctggggcagggaagtg
gagggtctccttgccagagtgtcccagcagcgccatccag >IGR3510a
catgctgtgctgaacgtggcactgaggtgaaaaggacatacgtctatgctccccaccccc
actgtcaggtacctcaggctttgtcaggagctcaaggtcaggagacctcatgcctggagg
aggtctggggcaggaagaggaggctggggcagggaagtggagggtctccttgccagagt
gtcccagcagcgccatccagctatgcacctcatacactccagagccttgggacctctgag
cacccaggtggtgcacccaaggacaagagcttacagtctctggtgactggattgtgggc
tttctctggactgaaaccacccttggaccctggccttgcactagccccctgacatctgatc
ctgaatcacagggctaccctccatgttctagatgatttggcaactttttctcaggcacagt
tgctgacctccagactgatgtgttccctcaaggtggagatgagcagtgggggtcttggga
tcctagggcaagggatggggtgggcaggtgtgtggttggcctgcatggctgcaggtgctg
tccgaagctttacagctgggcaggtttgtcgatgggcagatgtggcaaactccctgcagt
tctggcctgggctaagttgtggttgcaacttaacaattatgttccagaacaaatgggtct
ttatcggtcctggtcaggtggagaaactcacagttggaga >IGR3511a
tgggcaggtgtgtggttggcctgcatggctgcaggtgctgtccgaagctttacagctggg
caggtttgtcgatgggcagatgtggcaaactccctgcagttctggcctgggctaagttgt
ggttgcaacttaacaattatgttccagaacaaatgggtctttatcggtcctggtcaggtg
gagaaactcacagttggagagatttggattgtaggaagctgtgtggactgtgagtaatc
ccagttgcctccaataaaactcaaatgtttagaattcaagttagagctaagggtagggggt
cagagctttgtagcccagtctggcagcactttaggactcaagcaactggcatttcacccc
aggcagggcccagtgctctgcgggtgtgaggtggtactagtcatggaggggccgtcatgc
catggagacacaggagagtgttggccacggttttgcaggccaagaaagagattttactttt
gaggtcagatgactctgttggtccagaggaagccaggggtttggagatgtccctggcctc
tgtgggcccctcctcccaggtcccacactgtgcccagtgctctgtgagtcacctgaaa
ggccctgttcccctgagccatttaccagggctgacatttctgtggtgccgcactgggcct
tgagggggtggcagggctggattagatttagagctccca TABLE 5-continued >IGR3512a
gtccagaggaagccaggggtttggagatgtccctggcctctgtgggcccctcctcccca
ggtcccacactgtgcccagtgctctgtgagtcacctgaaaggccctgttccctgagcca
tttaccagggctgacatttctgtggtgccgcactgggcctttgaggggtggcagggctgg
attagatttagagctccccaggagctatgatacagaacagaggacggagagctttgatct
tcaagtcctggcacttggatctggagtgggcaggtgctgactgaggctagggaggcgggc
ctgggaaaggacctgaaatcttgagttctgatggacacaaggagaaggggggcataacaa
gttgatagagcccctactgtgtgcccactggcactggagatgcagtgggggttcagatga
ggtggggtcccatttgcctcatccacggccagatacttctcctgagagaccccgtggaact
ccaggtatggagcccagaaatggagccatcgcctccacccttttgcagtctaacaggactg
catccccacgaggctggactccatcatgactctcactcaccagcatttccacatgctggg
ccttattgaagcagcaggtgtcagttacagaaatgtgtcccaggcaccaccacccccaa
tacccacccacaccttgtctgccggcccagggccagcaa >IGR3513a
tggagccatcgcctccacccttgcagtctaacaggactgcatccccacgaggctggact
ccatcatgactctcactcaccagcatttccacatgctgggccttattgaagcagcaggtg
tcagttacagaaatgtgtcccaggcaccaccacccccaatacccacccacaccttgtc
tgccggcccagggccagcaaactcacaccccaacccagcagtaagttgttcctgatgctt
ttccaatcaatttcctgcagtgctaacctcgggagagggcaggagcccagagggtgccct
tgatcctcttagaagatttccatccttctatggatatgataacactctataaggcttcct
tgaacttggagaaatgactttactcaatagtaccattcttgggtgagtctgttggctaaa
cgagaaatacacatttcagtcatcttcttagtaggaaaaacaatgaataaataaagcaa
acgcttgtccttccagccatcctctaggaggtaactggcagccctccccaactgtttgag
ggagggcacaggggctgtgtggtgatggaagggtccagagtctgaggactatccatagtg
ttggagagggagcccgcaggataggcaggtcccgtggctgtccaggacagggacataagg
acaagcaggctggggaggagtacccaggactgtctgagcag >IGR3514a
cctctaggaggtaactggcagccctccccaactgtttgagggagggcacaggggctgtgt
ggtgatggaagggtccagagtctgaggactatccatagtgttggagagggagcccgcagg
ataggcaggtcccgtggctgtccaggacagggacataaggacaagcaggctggggaggagt
acccaggactgtctgagcagtgggaaagaggggaggcagctcagtcacttctccaggc
atgccctgcaaactgctgctcatccccccatcatgggttcagtgggcttcatcatc
caaaagaggcccaaggacagggcaaactggagcaagcttgcactggttctcagttcaag
tccatgacctcagcctgagtccatgaccagtcctgctctgacctgtctcagacctatccc
atgctgatccctgtgcatggggcttggcagagagcacagacagaaaccctgagaatctc
tgaatccccacttcctcacacccagccctgcactcccaccctccaccttgtgtcagtga
gtagacttcttttagattggagacaattccagaggatagccacctgtggcctaggagtag
caccagagaccttgcatgtggcagtcagggtgtataaaagccctttgcctcactgggccc
ctggctgtggtgcagggaaatgatgtctcaggttctgcta >IGR3515a
cccagccctgcactccccacccctccaccttgtgtcagtgagtagacttcttttagattgg
agacaattccagaggatagccacctgtggcctaggagtagcaccagagaccttgcatgtg
gcagtcagggtgtataaaagccctttgcctcactgggcccctggctgtggtgcagggaaa
tgatgtctcaggttctgctaagagcaaacagcaaacaatgtactttcagctttgggcaga
ttttgatgagttattccatgtccatgtaaaccttcgttatgtgatggtcctgtttgtcat
atttgttaatgagactcttcagggtgaaggtaaagttctttgtaaactcctcatagcaga
gctcctgaaacaggttcagggctctggtgcacagcagggcaccagatgacccagcctcat
ccatccctggtcaacctggacggaaggagccctggacccaagctcaggccctaccctgat
tctcccacaaggagacctgtgggtctcgcaggccaaacagtggaggcaatgggcatctgg
tctctccctgggctcagggctgcacttggttgggaggctcacctgctgactgagctggag
gtttcatccccacactctgagctttctcccagatttctcactccactatcccttgttgtt
atctcttccctgggcactgactggtgagatctctctctcc >IGR3516a
gggtctcgcaggccaaacagtggaggcaatgggcatctggtctctccctgggctcagggc
tgcacttggttgggaggctcacctgctgactgagctggaggtttcatccccacactctga
gctttctcccagatttctcactccactatcccttgttgttatctcttccctgggcactga
ctggtgagatctctctctccctgttcaaatgtggtatgaaaggtcccggggcagctgttt
cttacctcactggttttctggggcctattgaagggacccggaagccagagaaattggtc
aggagcacaaagggcactaagagcaaaataacgtttgatggagacccagacttatcttg
tgtgtgttattgtcagccgagagttctttctgaatgtcagcacagattgctgtgtacttt
tcgtggggagatatcgtggctactttcattgggaagaatggctttctgacccccagagca
catgagccaggagcacgtacaggtgcatggtattacttgaaggtgactccaagctggtcc
gagccctgggcttggcagcatttctgtggagaggggtacctatatatgtgaggctaagga
aatgctaaacctcttatcagtcatcactggcttacgcggaagacagagaggaccttatcg
ctgggcaagatgtgatttcatgcattttcaacaaccaca >IGR3517a
aggtgcatggtattacttgaaggtgactccaagctggtccgagccctgggcttggcagca
tttctgtggagaggggtacctatatatgtgaggctaaggaaatgctaaacctcttatcag
tcatcactggcttacgcggaagacagagaggaccttatcgctgggcaagatgtgattttc
atgcattttcaacaaccacagcacacttcatggattcttgcctgtgctgacactcaggct
tcatcctgagcgttcaccctgacttcttatttgtaatcacacctgaagtcacggtctttc TABLE 5-continued tgcatgagcatggagtgggtctctggccaggcctggcgctgtctgcaggtgctgactgaa
gtagaggaagcaagaggggtggtgggcgcatgactgcagacagtgccaggcaggggctaa
agctgccacaagccagcttccttaggcccacctgtcaaggagaagctggccctgctgccc
gcctaagacttggggcacatccacttcctcatagtcctggagggagatgagggaacaggt
tcaggaacaaggccttgagcccagctgtcaaagtaaggagaaggaggaggcctactttgt
ttttagcctgcaggccatgagttttaggggaaagtgcctgattagattcaaaatttcatg
taaaaataaaaaccaattcagaaacatgcggcactacagc >IGR3518a
ccacttcctcatagtcctggagggagatgagggaacaggttcaggaacaaggccttgagc
ccagctgtcaaagtaaggagaaggaggaggcctactttgttttagcctgcaggccatga
gttttaggggaaagtgcctgattagattcaaaatttcatgtaaaaataaaaaccaattca
gaaacatgcggcactacagccatgtaccaacaaattatgacctacattctgactctcag
agattaagatcacccatttgggggcaagtttggtaaatacgctgcactgtgacccctgtg
gtttggtttctttcccctgaacagttagtctattttgctgtttactttcggaatggtta
aatctcagagtgtgaggggcagggcgtggggcacaggggccaaggcctctacagggcagg
tgtcttgcctgatgccagagtgggcctgttcagccagtgaccagccaaccccccaggcctc
cccaggaagggtggtgcccttctctgggataagagttccctgggctggtcacttggactt
ccaggtgaacttgagagccattctctggggtgggagccctggagcatcccgggaagcccg
tccaggtgtgcagaattccgcacctatgcccggctctcacctcccctctgctctgacagt
gttggcccttggatagtgcccaacgcctgggaggccccg >IGR3519a
tctctgggataagagttccctgggctggtcacttggacttccaggtgaacttgagagcca
ttctctggggtgggagccctggagcatcccgggaagcccgtccaggtgtgcagaattccg
cacctatgcccggctctcacctcccctctgctctgacagtgttggcccttggatagtgcc
caacgcctgggaggccccgccccctctccacctccccgtttcctccctncctgcctca
tgggaaggcaggcaccnantggcatttgctcatggttaaaaacaaactagaacnntnnnn
nnntagaagcntattttaataataattattacggtaaaacatcttgaataaatatggaa
tatgaacttaaataaataaataaataaatatttaaaaatataaatatataaatattact
gatttctgtcagtataaaatattcccattcttctgccatgcctgtatcaggtcagtgtn
gcccagggcaggtccaggccactccaccatggctgtgggcccaccccttggtccctccaa
gatgaccatcctgagtttctagctcttgtttcatgagagagcagctcccggcttggcca
gcctcatctggccggtctcactcctggactggctcccagcagtcaaaggggatgacaagc
agaaagtccttcaggttctctttgaaactttcaaaggtga >IGR3520a
actcccaccatggctgtgggcccaccccttggtccctccaagatgaccatcctgagtttct
agctcttgtttcatgagagagcagctcccggcttggccagcctcatctggccggtctca
ctcctggactggctcccagcagtcaaaggggatgacaagcagaaagtccttcaggttctc
tttgaaactttcaaaggtgatantctgggttgcacaggaagtttccttaaaaaaagaaa
aataaaaaacacttgagtccaggcaagtgggtaacgtgggggaaggaagcaccagcatgt
ttctctactgcctcttagaactcagaggccaggaggcccactccaggacacacccactga
cctgggtcaggtgacgctgctgccacccacgtgttccccaaggagtgcatagctctgcca
gtggcagccagagtcaagggcctgacttaagtgccagcctgaggttggccttctgggcag
tcaaacgcctgcctttttggtcccagggcagagcagggcagctgagctgaggtcgtctct
gggcacccagaaggagtggagtcaaggccacaaactttgctcccttcccgcaggaaggag
tgcctgaggtccttgtccattccaagtagcctcccttccttgatcctctgcaantcaagc
acccatgtggggccagaggaaagtcctgccagaaggtgg >IGR3521a
tcccagggcagagcagggcagctgagctgaggtcgtctctgggcacccagaaggagtgga
gtcaaggccacaaactttgctcccttcccgcaggaaggagtgcctgaggtccttgtccat
tccaagtagcctcccttccttgatcctctgcaantcaagcacccatgtggggccagagg
aaagtcctgccagaaggtggcacttgggcctgggcacttcctctgggccttgggcaggcc
ccaagtttccttgggtttgccctcacctctgacctcattaaccantaatgacaataatga
ccaggataggagcagctcctgctggggagcactgtgggcttcagcgctctgtggctctga
ctccttgggatgaaatgggctgtctgcctcctctctggagggctaatcattacataactg
ttggcacagaaaccccctgggtcctgaacagccacagccatagatctctcccatgtcg
accncacccccctagattaagacattcctgctggaggccctgccgtaggcactcaccggggg
ttggagggcagtgctgnttgtagtggctggccatcatggtcaaggggcccttgagcttgg
tgaggctgccccgcaggccctgcttgtacagctccaggcgggtctgtaggcaggtcggct
cctgtggaaaatgtcgttcgtcggtgagcagtggccaagt >IGR3522a
acattcctgctggaggccctgccgtaggcactcaccgggggttggagggcagtgctgnttg
tagtggctggccatcatggtcaaggggcccttgagcttggtgaggctgccccgcaggccc
tgcttgtacagctccaggcgggtctgtaggcaggtcggctcctgtggaaaatgtcgttcg
tcggtgagcagtggccaagtgcccacagtggtacaagaactctccaccactccttttttgc
tgctgccccagccccaggagtagggcttgggaggggcacaggctgggtccagtcatag
acctgcccgtccatggcaggcacgaacctgcccttctcactgcccgcccaggccacc
ctcagcggcacctggagaggagcccagccttagggaaggaggtgactctcaccccatcat TABLE 5-continued tcagggagagggggtgggggcctcacctggacctgctgggtgggcaaggggttgttcctga
aaccccctctgtgcctctctgtagtcagcactgtctcaacaggacttggtctcggggcaca
gtgagcgccccaaacccacagctcctgtctcatgaagtgaccccactttaccacctgtc
ccctggtgactcctggccattgaatgctaggtctgcccatggccgctcagctgataaagg
agctcatgtgactgccatagggggcacggccagtagcctct >IGR3523a
tagtcagcactgtctcaacaggacttggtctcggggcacagtgagcgccccaaacccaca
gctcctgtctcatgaagtgaccccactttaccacctgtccctggtgactcctggccat
tgaatgctaggtctgcccatggccgctcagctgataaaggagctcatgtgactgccatag
gggcacggccagtagcctcttgagcacccagttgctaccccctcctcctgcagccagctg
actggagagaaagtggacaaccctgtgtggtgccatctaaaatggagtccccacctccac
cccagggcaggggcttctggaaagctatgtcagagagaagcatcttacctggaggtcaaa
catttctgagatgacttctactgtttcattctgtagaaaaggaaaatgtcatgttatcaa
gctgacaggcgtggccagtcagggggccagctgggtggcctaggcacaggcccacattctc
tcacttaccatctcagcagcagtgtctctactcaggttcaggagacgccgggcctcctgg
atggcattcacatgctcccagggctgngtgctggggctgggcgagcgggcgggtgcagag
atgctgcaggccacagtgcccaagagcagcaggctctgcagccacatcctccagngaact
ttagcctttctctctgtgtactgggctcactggcaaaaga >IGR3524a
agtgtctctactcaggttcaggagacgccgggcctcctggatggcattcacatgctccca
gggctgngtgctggggctgggcgagcgggcgggtgcagagatgctgcaggccacagtgcc
caagagcagcaggctctgcagccacatcctccagngaactttagcctttctctctgtgta
ctgggctcactggcaaaagagctcttaaatacacagaggaaatgattaatggtgaccaca
aatgccagggaggcggggggaactacctgaactgtggaatctcctggcccttatcagcca
cacatgggaacggtgagcctttttcctaggtggtcaggcttggggggttttcattaatgaa
cctttccaagaaccgacagcccacccaccccgccttcctgagggctctccagccctccctg
ggcagtctgaatgggcctgaggctgccccctccctctgaggggcacagtttggacttcct
ggcctggaatggctggggtggggcgtgggagacacttagatagggctccccatcctgcct
gtaatcccaggggcctttgggcaggctatgcccgccctggtgcctcattctgactccagc
cttcctcttctctggccactgtgagagacttgagtgtgaggggagctctcacagacctgc
cccactgacagttcacatgggctcccacccaggacctgga >IGR3525a
gggcgtgggagacacttagatagggctccccatcctgcctgtaatcccaggggcctttgg
gcaggctatgcccgccctggtgcctcattctgactccagccttcctcttctctggccact
gtgagagacttgagtgtgaggggagctctcacagacctgccccactgacagttcacatgg
gctcccacccaggacctggagcaggggggcaacctcagtccagtaagggggggaccctgcc
cctgtgagcagagggaatgaccaccatgtgcacatccagcagcgagactgcagccactct
cagcaagcttcagaggggtgtggctgggtcaagtcgggacccagagtctgactcttggc
tctggagccaccttcctgagtgactcccctctctggttatgtgaaccttgattccctctg
cagagcaggtttgccctctgaggttcggactacactcctatatgtagccccccagaagac
accaggagcttcaggctggctccagggctgtggctgcatccatctcaggtacagggacaa
tggcttccccagcaaggccctccaggcttaatttcctacataaccccagcatcccccaac
tccagaggcctttctgtggaagtgtggaagtaggaaatctaaaggctcttgaggggctga
caagtgtttgattttcacaatggagttcagagaagacagc >IGR3526a
tccagggctgtggctgcatccatctcaggtacagggacaatggcttccccagcaaggccc
tccaggcttaatttcctacataaccccagcatcccccaactccagaggcctttctgtgga
agtgtggaagtaggaaatctaaaggctcttgaggggctgacaagtgttttgattttcacaa
tggagttcagagaagacagcacgagtttgtgtttgcacaaggtatctggctcaagctgcc
ccatgcctgggtttcatagctaaagggtgtgggcccacacgtgcccatttctggtgta
tgtgtgctgctgtgattggttgtacatacaggtgcctggtagaggggaggatgttttcca
tgcagatgcatctattgagtcctcttacctgctttatgaaaggctccaggcctctgaagg
tgactctgatactggagaagctccctactccaggtgcagtgcctctgggcccctagaggct
gattcagcctaaaccagtggggttggacacaagcgagaacattctgctgcaggttg
gcgagccttcagagagcaggtggagttcatggctttagcactgtggtctgagtctgcagc
cctggccagtttccctgtactgtgggagttttctgaccttgcatagagaaaccaaacct
tagtcctccagaccccactgtgaggccagcccatccatc >IGR3527a
ggttggacacaagcgagaacattctgctggactcaggttggcgagccttcagagagcagg
tggagttcatggctttagcactgtggtctgagtctgcagccctgccagtttccctgtac
tgtgggagttttctgaccttgcatagagaaaccaaaccttagtcctccagaccccactg
tgaggccagcccatccatctgagcctgcgtagaacactcctagtggccaggctggggtg
ggaacatgaaatgtccaggccctgccctttctccaccttttttgcaaggccttggctca
gctcttccaggagctctcggggagagatgaggacatggatactacatgtagatatca
catgtgttgatagcacctggaggctggagggcagggaagggagccatagatagtggtt
cagctgatggccaggggaggcagagagcctgtatgacccatctgggagagaaggtcacttt
cctcctagaaatgagttgtcatagctcagacagtcagtcaacaagtctttccaatccaca TABLE 5-continued ccaggacctgttctggggaggtaaacgggaccctcccactggccctcacatttggcccttgaggctcccagtctggtaggaaacagactgcaatggaccctcccatggtgtgaccttgactcggcaggggggaagtccagagctgagggatcccagagggc >IGR3528a
atagctcagacagtcagtcaacaagtctttccaatccacaccaggacctgttctggggaggtaaacgggaccctcccactggccctcacatttggcccttgaggctcccagtctggtaggaaacagactgcaatggaccctcccatggtgtgaccttgactcggcaggggggaagtccagagctgagggatcccagagggccaccttctctagcttggggatccaaggggaccagagagctcactagagatcctgcctgcaagcccaggctgaaaggctagaagtcaggtgggtacgttggggttggaaggagaggggcaggagaggacaggggagaatgttctgggcacagggagccctggggttttaggaatgggtataaggaacagcaggcagactccagagagattgaggaggtagaatctcaacaggacttggtgctatagtgaagtcactcagtcattcattatttttgagcatctactaggttcccagcagggaaaagggacataaggatgacaaaatcggtcagggtcctgcctccaaggacttttttaaccccatccatggaggagcaagattagtctactcaccccccctcccccccaccaaagtgtgctctgaatgtgagtaagaggagttagaatcactgtccacatggctaaggtgaggacccaggggacaaaggagcagatcttcag >IGR3529a
aaaagggacataaggatgacaaaatcggtcagggtcctgcctccaaggacttttttaaccccatccatggaggagcaagattagtctactcaccccccctcccccccaccaaagtgtgctctgaatgtgagtaagaggagttagaatcactgtccacatggctaaggtgaggacccaggggacaaaggagcagatcttcagagcgtgaggcccacgggaagttttggagtttcagagtctgcatgtacaggagacagatctggcagcggtacatgtctgtgtggtagctgaggccacggaagttattcaggaagaagagctgagggccagcaaagctgtgtttaagggctgggacataacagatgggcaagtaacaggccagtggccaagggcctaggagggaaggaaaggaggaaagcaagagtcataataagaaatccatttcggcagtggtggcctgcaggtgcccaagtcagcacaaacaggacagaaatccatgggtttggtgatgaggtttgtgggcagccacacatctttctcatggaaagatgacatcagggctgaggccatgacacaggcaggcattcctagattgcactgtatttaaacagtgtcaaccgatagccagccatgctgactcaggggctccgatgggctgtggcagggcagaggcggggaccacgatgggtggtatgaccc >IGR3530a
tttggtgatgaggtttgtgggcagccacacatctttctcatggaaagatgacatcagggctgaggccatgacacaggcaggcattcctagattgcactgtatttaaacagtgtcaaccgatagccagccatgctgactcaggggctccgatgggctgtggcagggcagaggcggggaccacgatgggtggtatgaccctctggggccccccttcctacagagacaggngaaaaccctctggaaggagtttcctatgcgtgtccaccccacaggctctgtaggaaacaggggcttgagtcactccaggatccttatnacgagagacattatcacaaggggaaggaaatgggcctcaaagtcccttcggtaccatggcaccccgcacaggctttgggctgatctgatccttctttgacctgtccaacccttgatgagggttcttgttatctctggggacctgagatctgggagaccagtggtcagcccagtccacacaatcagtgaccgcagaaccagaatttgaacccatatctgttcctgctatcctagcattttccattgtcttggggtcaggaagttgggaaatgctgatcacctggctggaccagcaggggggtggacccagcgtgcttgtcccctcaaggcagctgtaaagagagatgcctgccaggtgttcgcaggtaggctggagtggcc >IGR3531a
aatcagtgaccgcagaaccagaatttgaacccatatctgttcctgctatcctagcattttccattgtcttggggtcaggaagttgggaaatgctgatcacctggctggaccagcaggggggtggacccagcgtgcttgtcccctcaaggcagctgtaaagagagatgcctgccaggtgttcgcaggtaggctggagtggcctgtgactgtcccagggaagtctgggctgaaggcagagtttccccagcagatcctgccatccaggcatctctatgccccaggcttgggctcttgcccttaccagccaccaccaatccctgaagcctaggaaagtccctcctccctgagcctcaacccctgcatctgtacaatgggttaatggccactgcctcaccgaggaaactgttgcctgccccaggaaactctgtgggagatcctcccaggaagagacaatccttcaatttctcctctgcccagtgctaggggagatttctgaagcccaaactgggcagaggagcgaggcctgctggagtttccagggacagctgccccttgcccagccctagccgcagagggcaaccttctggacacacgtggtgaggtagggagtccggcctccacctgagtcagggctcctgggtcctgcatcaccgacaggagatcctggtaccgcatggcaccatgagtggtttgtccttc >IGR3532a
ccaaactgggcagaggagcgaggcctgctggagtttccagggacagctgccccttgcccagccctagccgcagagggcaaccttctggacacacgtggtgaggtagggagtccggcctccacctgagtcagggctcctgggtcctgcatcaccgacaggagatcctggtaccgcatggcaccatgagtggtttgtccttcccttgtcactccaggccacaccagacatatgaagcaacatctctggcttctgcggtttcagcccattctgtccccacgtgcatccctctgtctcggtcccaaatgtacacctcaaaagggaagctgccctcgccaagctccaattccagtttggcctcttggtattcccaggttcctggcactggggagtgccaggaggcctggaggatctgaggtggttaaccctcaaccacatgtggtctctgcatctattcagccaagcttccgggagggtttgctgcggagtacgcacctcacaggccccttgcactcggagagctcacttctggtggt TABLE 5-continued cccatggggtgggggacagggagcacaaggcccacactcataggcagagacatggagacc
atttgctgtgatgggggagacacaaggtcacagggaggtttgagaggtcagcccatgttg
cactggaatggcaagtttgagaggccaggggacctccagg >IGR3533a
tcacaggcccttgcactcggagagctcacttctggtggtcccatggggtgggggacagg
gagcacaaggcccacactcataggcagagacatggagaccatttgctgtgatgggggaga
cacaaggtcacagggaggtttgagaggtcagcccatgttgcactggaatggcaagtttga
gaggccaggggacctccaggaagactcagtcagttgtggccatgtgggtccggaagtcag
ggcatttggaagtcactggtaaagaggaggctcccaacaccagaggggctgtggagagtg
agccaggcagaaagtagtggcggggtgtcaacttttgaggatggccaaggacaatgagac
ctccttgtttgcttctttgttcttggggcttcctttttttccctcaggatctggcaactc
caccatgcacatcactcaggcagaggagtccttgtggacacaaacgcccaatgggtgtgc
caggccttccaccacagtgccctccctgacctgtgtctactactcgcctggtgtactcc
ctctagggcagaaatgcatcccctgctcctgagtctctgctctgagcctcatctctggc
tgggaggatcatcaggcacccagaggggcacagcctatgtgtgccctcttgggaagagc
catcgggaggtgcattaaaaatcaaaagcaggagaaatca >IGR3534a
ccctccctgacctgtgtctactactcgcctggtgtactccctctagggccagaaatgcat
ccctgctcctgagtctctgctctgagcctcatctctggctggggaggatcatcaggcacc
cagaggggccacagcctatgtgtgccctcttgggaagagccatcgggaggtgcattaaaa
atcaaaagcaggagaaatcatgagaccagaagcctgtataatttctgaagtcctgcaggc
atccgttcctgccctctatgtctggagctagagtctgggtcaagatgccaggtggaagtc
ccaggcccttgcccggctcgcgcacctgcatcccccctggaactgatgggtcagaattgag
gtggcagatgtgggctttctgctctcagcaggacgagtggttctggaatgagcctcctcc
aagactcttctggatccctcacgggtccctcagactttcctgaggccctgtttgggcag
gcacagctcgctgcatgtccttggcctgtggcctgcccccttctgagcccggctggctca
ccccacagggcatgcagcactacttttgcaggctgttgggagatgcactggatatctgca
agggaaggtgtttctgttttggttttctgttttggcttgctaggtgcctccatctagcct
cagtctcgctgtccatcaaagagagggaatggttaccagg >IGR3535a
ttggcctgtggcctgccccttctgagcccggctggctcaccccacagggcatgcagcac
tactttgcaggctgttgggagatgcactggatatctgcaagggaaggtgtttctgtttt
ggttttctgttttggcttgctaggtgcctccatctagcctcagtctcgctgtccatcaaa
gagagggaatggttaccagggtccggaccagcctcccagccttctcattccctggaggtg
agtgtaaatttaggtttccctcatgggaagtgggcctgtgtagaccctccccagggccc
taaagcctcccaccccagccccaggaggcaaacgccacctgcatcctggtgctcgagcc
tgactgatggcaaagtggctgagccatacagattttccagaaagagccagcttggaacac
caggacagggaaccatcctcctcagtctttccacttgtcctggtggggaggaggtggtcc
aaggctgccaggggcagctcttgagtctggccatcagcctgggagagcaggggagtcatg
ttgatcacagacccactgcatgggacatcctccctgattcaaggctctctgaatggtag
tggcggctgcccagtgttttttattccttatgctcaggagggcctcggcccagcccatggg
atcaggacacagagcaggtgcgcagctggtgctcacgaag >IGR3536a
ttgagtctggccatcagcctgggagagcaggggagtcatgttgatcacagacccactgca
tggggacatcctccctgattcaaggctctctgaatggtagtggcggctgcccagtgtttt
tattccttatgctcaggagggcctcggcccagcccatggatcaggacacagagcaggtg
cgcagctggtgctcacgaagggaggcagggaaggagaccctgctctgctgctcggcctt
cgctccggcgcccgctgccctccgttgcctccccacagctgtcctccctccctgacaccc
tgacttggcccctcagggcacacacatcatccacacagcctgctgtccttgctgcccgct
gatctccagcacagcccactttccctccaggaaagggctgagtctccaagtgcaggcccc
aggcaagtctctgccaaagcaggtcccgggagcaccctgggtcaagggctcatgagtctg
aggaggagggaaggaggcctcacaccagaaggattccatggaccccacagggcagggagg
gctcatggaagggaaagggaaggggtcactcatgagccatggctggaggtagagttgagc
ttggggtctttggggagcctgagtgggagctggaggaggccttgacaaccagccatggca
ggggacagctgggagccagggtctctctcagaagttcctt >IGR3537a
cacaccagaaggattccatggaccccacagggcagggagggctcatggaagggaaaggga
agggtcactcatgagccatggctggaggtagagttgagcttggggtctttggggagcct
gagtgggagctggaggaggccttgacaaccagccatggcaggggacagctgggagccagg
gtctctctcagaagttccttaaggcatggggacagagacaaagaggagcacagaggacca
cctccctggatctaagcccccaatgtgtgtgttggttgtggggagggggtgccaggtagg
aggacaggacagatgggcgtgtagaggcatttactgggcaatatgagagtggtcaggtga
gaagcatggagctgaggcgctaaggctgcgctgctcactgtgggcctggaaccaggaggt
tgtagggcagaagttaacacgggaggcttggatccagtcaaggggagaccccaggcacat
ccagggtcagacttaaaagaattcctgggcctcagtgggcattagtgaaccactgttgct
taaggattcagaggctctggactcaaataaccttcattttttctgcctcagtctctgtctg TABLE 5-continued tgtaatggggataatcacagcctgggtgcctgggtcattgtggggattctttgagtccct
tctcagtccaggagggcagcagcaactttgctgacccacc >IGR3538a
attcctgggcctcagtgggcattagtgaaccactgttgcttaaggattcagaggctctgg
actcaaataaccttcatttttctgcctcagtctctgtctgtgtaatggggataatcacag
cctgggtgcctgggtcattgtggggattctttgagtccctctcagtccaggagggcagc
agcaactttgctgacccacctcgttgagcttgacctgaggctttcaaggggggaaagttgg
gcccctagccccacccctggtccacaccacctctgcctcctctccctctctcccaccat
gggtccccatcttcctgggcccaggattcccctctgctggaccagcccctatttcctc
cagcacctctctccctctgcccttgctccttcttgttggtgttaaacacacagtgtctgc
catggctccatcctgtccttccgcctccctccacccacccctcctcaggccacagtcatc
cagtcttaccgtctccacagcggccagtctgggctgggctggcctgggatcagagaggga
ggaatggggagaagagactagctaagacccagaggtgcctggggcccaggctggctggc
tccaggggcaaaagcagtgacccagggcacagccttcaccttggacacttggcacccagc
cacactctggcctctccactgcttagtctctcctgtgcct >IGR3539a
cggccagtctgggctgggctggcctgggatcagagagggaggaatggggagaagagacta
gctaagacccagaggtgcctggggcccaggctggctgggctccaggggcaaaagcagtga
cccagggcacagccttcaccttggacacttggcacccagccacactctggcctctccact
gcttagtctctcctgtgcctccgcttaccttgtcttctcgacctccatgccctcctcccc
cagggcatctgcctccttcttccctgtgcttttccacccttctctgctggatgaactt
ctctctcaggccccttctgtgccacccatgggcagtgcctccgatgaggtccacgcccat
ccatcggtcctgtgctgtctgtaatgaccccaccgcactgtgctgggccaactgcacaa
ggccaggaggcctgaaaggcctggcccagtgtctcacctatgcccgcccagcctggggg
agccgtggagggtcctcagagcagttgctccactgagtcaaatgggggcttgagtccagg
gcaggaggaacagagcccccttcctggagtgggaggattcctgtcaaggggtgaggcttgt
tgtgccttctgagttctgccctccttaggcacttgcctttctgtcaattttccctttgtt
ttattttctgcatttccaagttttcagtaaagagtata >IGR3540a
gcagttgctccactgagtcaaatgggggcttgagtccagggcaggaggaacagagcccct
tcctggagtgggaggattcctgtcaaggggtgaggcttgttgtgccttctgagttctgcc
ctccttaggcacttgcctttctgtcaattttccctttgttttatttttctgcatttccaa
gtttttcagtaaagagtatatacgctttcccatcttctcctccaatgaaaaacaatagtt
tttgttttttttttttgagatggagtctcgctccaacaatagttttttaagtgaaaaataa
aattcctggctgagagctgtaatccacctttcccctgagcagacacctgggatgtgggaa
ggcaggaacttgggccttctctggtggttctgggatttataatggggcgatgctgccccc
tggcgccatctggacacacagacctggcccaaaggacaggctccacatcctaatgccatc
acagtggggattcaattttaacatacaaatttggagggaacataaaccttctgtcaaagc
atgtagaaattcccccagcctgtccaggaactgactgccacttggttctggccccagtct
ggctttaagctgcagtctatactattccagaaggtcagcgaggagcccccagcgcatctg
aaaaggtccgcccactgccctccagcatgtcacctccg >IGR3541a
acatacaaatttggagggaacataaaccttctgtcaaagcatgtagaaattcccccagcc
tgtccaggaactgactgccacttggttctggccccagtctggctttaagctgcagtctat
actattccagaaggtcagcgaggagcccccagcgcatctgaaaaggtccgcccactgccc
tctccagcatgtcacctccgcgtgccaccctccgccagcgacaggtcctgacgactggcc
tcgtgcaccaggtctgtgtctgatccagccactaaccctgcctcttgcaggcatcagtca
ctaacacaggaccagcagaggagacagctgctgacccactctccagggtgtgaagaggag
gtggcaagcagcgactcatctgggaacatgggctggggcacaaatgctgcctcagccca
ggatgaaaacaggactagctgtcacgtgcgagagggagggaaagtgagggctgggggag
ctgggtgtgcaggagacttgggaaacccagtccagagtcagacctctcaccctaccctct
caggcctggctcctccaggacctctgaagtgccctgagaccagtggcacacacctcccc
tagtggtcaatccagaaactgcagcagcatcctctgtatctcctcccaggctaagtccaa
caacagacatcccctggtccccaggcaatgccctcagtga >IGR3542a
ggaaacccagtccagagtcagacctctcaccctaccctctcaggcctggctcctccagga
cctctgaagtgccctgagaccagtggcacacacctcccctagtggtcaatccagaaact
gcagcagcatcctctgtatctcctcccaggctaagtccaacaacagacatcccctggtcc
ccaggcaatgccctcagtgagccaggctggggagaggtgggggaggggaaaagagagt
tcttctgtgggaacataacgattttttaggggaagaatttagggaaatagagttctgag
cctgtagcagataaatcttccatcatctccagtcccattcaagcagccgggctgttcctt
attcataacctcaagggagggatggatcaaggtggaaaacaggaaaaaggggacaggac
ccctgcacctggtgtcagcctctgacgcttttctgggacttgagaggaatcagagaggat
gctattgctgcttacgtggtgacagaggaaggcccctctgcccctccttccactggcaga TABLE 5-continued ctgagtagggccacagggtggtgtgcaggggagttagagggggggcactcagggctaaagg
gccaggtggtagactgaagccacactcgggatgtcccagcctcctgccttctgcctccag
gctggtctgcaccacctccgtgccacagtggctgtccctc >IGR3543a
gacagaggaaggcccctctgcccctccttccactggcagactgagtagggccacagggtg
gtgtgcaggggagttagagggggggcactcagggctaaaggccaggtggtagactgaagc
cacactcgggatgtcccagcctcctgccttctgcctccaggctggtctgcaccacctccg
tgccacagtggctgtccctccagtgggtccctgtgtacccacctatttcggaggagggcc
ccatcctgggatggtgtggacagtccagaggtgggcagagtttgagttggtccatggaat
aggaactcatcaagccaagtaagggcatgccagactgaggtgacaatgtggatagaagct
ccagggcatgaagagaggcttcatggaaggctgtctaggaagtcccagcactcctgttgg
ctggagcattgattagggtggtagccatgggggaaacagaagcaacagatggaggtgagc
cttatacgttgtcctaaggatatgacaaggtccagaagaccccgaggactgggggattc
agtatagatccacatggtcagatttgcattttctaaaactccatctggctccccagtaga
gcacagatcgtcaggtgtgggttccagggctggccgggaggcctacagggtggctgcta
aatcatcaggcaggagaggctgggggcttaggcaggggtg >IGR3544a
tatggacaaggtccagaagaccccgaggactgggggattcagtatagatccacatggtca
gatttgcattttctaaaactccatctggctccccagtagagcacagatcgtcaggtgtg
ggttccagggctggccgggaggcctacagggtggctgctaaatcatcaggcaggagaggc
tgggggcttaggcaggggtggagactccaggcttggaggttttaaaggaatggaatgaa
gaattgggtggcttgtgtcagcagaacctgctgccttgagggggtcagggatgttgatc
cctgatgttggccctgggaggagcaggggcggcggctgcagtttctggaaggaccactag
ggggagacatgccacaggattagcatgctccagaccacagggacctgaattcaagcccca
gctgggccactatcagcttaggcagttgctcaaccaggccgaacttcagtttcccatgaa
acggagaaaacatactcttggttggggtgaggaataagttagatagcatagtaaaatgc
tcagaacggctcctggtacctggtagcagttctgtggattttcaagattgctagggttat
catcacctttctggaaatgggggtggcaggagggcagtgtgagaacaagctcacccagac
agcatccacgtggcaggatcaagccacccaggatttgtgg >IGR3545a
gttggggtgaggaataagttagatagcataggtaaaatgctcagaacggctcctggtacc
tggtagcagttctgtggattttcaagattgctagggttatcatcacctttctggaaatgg
gggtggcaggagggcagtgtgagaacaagctcacccagacagcatccacgtggcaggatc
aagccacccaggatttgtggcacaccagtctcccttaaaatggtcactaagtcccaagtc
aaattgagacactggtaacaaagcagttgttcagagtctagtttattctcacacatccct
aggaaccagtttaaaactcgaggtacaaatgaacatgctccccacccactctgagttttt
ttgcagaagcagcaggacatggctcctctgctaaaataaatacagttcacactccaggca
ataaataaataaatacatacatacataaataaatagtctcaatgggataaaaatgagaac
acaaccgcacaaggccaaatgggagctgcacatttcagaaattagataattaacaattca
tctgatgccgcaggaaaaggtgaaatgcttctggtcctggaatgtgtgagagatgaccca
gaggtttcagaagttctgctgtttttgatgtcccgaggcnctgtggtgagaaggcccaga
gaacgagctggacgttggactnaaaagatcgcgaggctca >IGR3546a
gggagctgcacatttcagaaattagataattaacaattcatctgatgccgcaggaaaagg
tgaaatgcttctggtcctggaatgtgtgagagatgacccagaggtttcagaagttctgct
gtttttgatgtcccgaggcnctgtggtgagaaggcccagagaacgagctggacgttggac
tnaaaagatcgcgaggctcaaagtcgtctgttgagcctgcgcattctcaagggttttcag
atagaacgtcagtttcctccggaattcattccagtcaccgtccttgatatggattggatg
tcgctataaagaaaccaagaaggtggcattaggtgagtccaggctgtaatggtgatgacc
agctgaggagcaagccatgacgggcatcttggggacagcttaccgtgggtgcggccgtg
gccaggggcagacatggcaggagattctgtggaaagagaccaaagcagatggtcagagat
tcccttggaaagggagtgggccctgctctcctccccagaggcagggcagggccaacacag
ggatcccaaaccctcaacagcttcacatactttaagaatgctctcaattgctgatgcgtt
ctgtaaactcttgacagccctgttgaatgcctccaggtttggccttcgaaggttatttt
ctaacggggcagagaatacacttaaggggggaaaggttaca >IGR3547a
ccctgctctcctccccagaggcagggcagggccaacacagggatcccaaaccctcaacag
cttcacatactttaagaatgctctcaattgctgatgcgttctgtaaactcttgacagccc
tgttgaatgcctccaggtttggccttcgaaggttattttcctaacggggcagagaataca
cttaaggggggaaaggttacagagtatccctcccacaagcaggtggaagtcacccccacag
tttcccaagcccactgttggggacatcctcgggttccctcctagtcccgttcttgcctca
ggtgggtccctgcccaagggcacaggcctagaagtgagtggcaggcaggacctggtttcc
tcaagccccccagtctctggctccatttgagctacataaagggcctaggtgggctgggcgc
agtggctcaagcctgtaatcccagcactttgggaggccgaggcaggcagataacctgagg TABLE 5-continued tcgagttcaagaccagcctgaccaatatggtgaaacccgtctctactaaaaatacaaaa
atgggagtggtggtgcatgcctgtaatcctagctacttgggaggctgagacaggagaatt
gcttgaactcaggaggcagaggtagcagtgagctgagatcgtgccactgcactccagcct
gggcaacagagtgagactcttgtctcaaaaaaaaaaaaaa >IGR3548a
accaatatggtgaaacccgtctctactaaaaatacaaaaatgggagtggtggtgcatgc
ctgtaatcctagctacttgggaggctgagacaggagaattgcttgaactcaggaggcaga
ggtagcagtgagctgagatcgtgccactgcactccagcctgggcaacagagtgagactct
tgtctcaaaaaaaaaaaaaaatgggtggggaggggtacctaggtggatctttctgcac
ttgggggaaaaaatatctccaaaaagaagctctacaaaagacaggggggttttccaaggga
agtatttgtagctcagaggctgataacagtgttcatgccctgactgaattaaagtctcct
agaaatcaagaagaaatcacagagaccccagcatggaaatgggtgcagcatgtgagctg
tgagtgccccaaacacagatggcccaggaactcagcaaaggtttccacttcttgtttgac
ccaagaaatgtcatgcaaaggtgagacagaacaactgcaaccaactggaaccatgaaaaa
taactgtaaatgataatgccacagccaatgagggtggaaaacacaaactcaattttttaa
gggaaaaagaagctggcacatctgagggggaaatttctgtctgcagtccagagtctgcc
ctaccaaacactgaccttaaggcccttggtattcctcacc >IGR3549a
gtgagacagaacaactgcaaccaactggaaccatgaaaaataactgtaaatgataatgcc
acagccaatgagggtggaaaacacaaactcaattttttaagggaaaaagaagctggcaca
tctgagggggaaatttctgtctgtcagtccagagtctgccctaccaaacactgaccttaa
ggcccttggtattcctcacctagaactgccttttcattttctaatttaaaagtcattttc
attattatagccatggctgtggccatgtattgaactcttaagtgccagatgctgggccag
aacatgcacattgtgccatttgattgtcataacaatcccactgagataggtgctattaac
cctattttacagatgaagaaagcaaggctaggtaagatggaatgacatggctgaagtcac
ccaggcaggaagtggatcgggatccacgggctgagctcttaccatcagaatgtcttggtc
ttccccattgaggttgttgaagtcctgtggggtgaagggagagaaaggcccatgaggcc
ttttggccttaggcagccaccacccctcactgctgcaggccagtcttatccaagctactc
accagcaaaggcaaggtggctgctttaagtgtgttataatttcatcgatcatgttagag
cagttaacccagcttgtcttcaaggncgttgtctgggtca >IGR3550a
agtcctgtgggggtgaagggagagaaaggcccatgaggccttttggccttaggcagccac
cacccctcactgctgcaggccagtcttatccaagctactcaccagcaaaggcaaggtgg
ctgctttaagtgtgttataatttcatcgatcatgttagagcagttaacccagcttgtctt
caaggncgttgtctgggtcatgggagcttggagtccggggcggaccaggagttggagcag
gagcaggacgggcaggcggctcatgtttggatcggcaggaggcactctgtcttgttctgg
tccttcgtggggctctgaagagttggcaacaacctcccgccttatatgtgcagcagcaag
gtgcccacaaccccgggcaaggcgggggaggtggtggtgtgggcaggcgtcggaagga
tctttatctgacatggaacctccatagaaaaccacagacgtaattattcatccatgactt
tctagtactcaagatcagtgaaacaagaaaaaagattacttaaacgttatcacttcatct
tgtcaaggaggatgagagatgggaagcatggcagcaggtgagaggacccctgtggcagga
aggggaagcctgactcagctcactgaggcctcctgcccagtgggatctcatctgccatca
cctggactaccctggccctctgctgcccgccctgcttggt >IGR3551a
aaacaagaaaaaagattacttaaacgttatcacttcatcttgtcaaggaggatgagagat
gggaagcatggcagcaggtgagaggacccctgtggcaggaaggggaagcctgactcagct
cactgaggcctcctgcccagtgggatctcatctgccatcacctggactaccctggccctc
tgctgcccgccctgcttggtcctggtgggtggccaggaggccactggaacagatgagagt
ttgtctggtagccggtcacgctgctaaacatccacgttcagcctcaggctctgagaagca
catctcttggtgccgcttcccaatacagaattactggtgttccagtcccagtggtttgt
cccatgggcttcgggcagcttctccttgacactttgtttctggtggatgccgagggcgc
tcaggcccccaggtggccattctcttactggtctgctagcagtggcatggctgttccctgc
gtgtgggactcagcctctgcaggagcccggctgcagcccctggcagtccctctggtagc
accgagagctgagctcaggtacctgaggacactgtcactgggagctggggagggctgg
cctgggaggtttaggaggcagaattggcatggtctgaggggtgaggtcaaggaggagaa
aggagagcaactccctggtttcagactgggcctcaggctg >IGR3552a
aggaggcccggctgcagcccctggcagtccctctggtagcaccgagagctgagctcaggt
acctgaggacactgtcactgggagctggggagggctggcctgggaggtttaggaggca
gaattggcatggtctgaggggtgaggtcaaggaggagaaaggagagcaactccctggtt
tcagactgggcctcaggctgctggggcagggattggcaggagacagttgtattgagaggt
cttgatcccgtctgtgctgagcatggatttgccaggtgcaggcccagtaggcaaggttt
gcagagagggatgtgagtggggacagaccatggggaaatccacaagggacctgagaaac
tgcagccagataggaagcaggaaacccagaagggcgggggtggtttatcccagagggcagc TABLE 5-continued ccctgagagaagaggggtcctcctgatacgggcctgtcttggggcctgcctgacccaccc
catgggtaggggcttttggtaaagggatgagtgtgacaggggcatgtggaagacttctt
caagatgattggccccgggtgggagggagaggagagcagtaaggaaaggccagggtctgg
gtcatggtgcggtgtgttgtgatcagtgtggggatgcgggataggaggttatgctgagg
cagcggaatttgggtgctttgggcttctgagcataagcag >IGR3553a
taaagggatgagtgtgacaggggcatgtggaagacttcttcaagatgattggccccgggt
gggagggagaggagagcagtaaggaaaggccagggtctgggtcatggtgcggtgtgttgt
gatcagtgtggggatgcgggataggaggttatgctgaggcagcggaatttgggtgcttt
gggcttctgagcataagcagatcaggtgaagacaaggaccaggatgtggctgtggggagg
caggtgaagaggctgtgactcaaggccatgctgtgaggatgatttctgtagctgatatgc
cctcctggctcagcccaggctgggccctggaccaggaagagccctaggttctggacccg
gagtggagtctgacaggcacaactcaacacacagaggggcttagcaccagcttgcgt
actccgtaggcacaattcattcaacagacgtctacaaagcacttgctgtgaataaaacag
acatggtaacctccactagcagctcagtcttgtgaggagacagatttccagtcttgctac
ccttcctgtggtcccagacctgcaggtcagccctgcccgggagcttgttagcggtgtcaa
ccctcaggccccagcccagactttctgaatcaaaaatcgcattttgataagatcctcagt
gattcagtgcatttgagggctctgatctaactacctcag >IGR3554a
agctcagtcttgtgaggagacagatttccagtcttgctaccttcctgtggtcccagacc
tgcaggtcagccctgcccgggagcttgttagcggtgtcaaccctcaggccccagcccaga
ctttctgaatcaaaaatcgcattttgataagatcctcagtgattcagtgcatttgagggg
ctctgatctaactacctcagcaatcttagctccggtagggtcccctattgcccacggac
ccagagtttgttccttgcatactcaactgtaccttggtgttactgtctatgtaaacgttt
tggggacttgtgcacaaataatgtgattccttacagagaaagctgtattttttttagtg
taagtgggcttttctagggaatttttaaagttcaatgaatttaaagctgtggagacaaaac
attcctgtatttttttttgtttctttaaaagtcaagactttgtgttgtaaccacacatgc
acacaaaatcctgaatagtagtattgtaaatcttgacatttgtagtgttttttctcattttt
aaaaatgaatatataccagcctgagcaatttggcgaaacctcatctctacaaaaaataca
aaaaattagccaggcgtggtggtgcacacctgtggtcccagctacttaggaggctgatgt
gggaggaccacctgagcctgggaggtcgaggctgcagtga >IGR3555a
gtattgtaaatcttgacatttgtagtgttttttctcattttaaaaatgaatatataccagc
ctgagcaatttggcgaaacctcatctctacaaaaaatacaaaaaattagccaggcgtggt
ggtgcacacctgtggtcccagctacttaggaggctgatgtgggaggaccacctgagcctg
ggaggtcgaggctgcagtgagttgtgattgtgccactgcactccagcctgggcgttggag
tgagaccatctctccaaaaaaattatatatatacacatagtttattaaaggcaaaagagg
ttgaggcttcatgctaggagcattggaggacttgcggggttttcaaccagggggaggcgag
gtgaagctcaggtgcacctgctgtgggggaaaggatgagaaagttcaaggcagcagggtg
gccagtgaggagatattgggagtcctctggaagacaggtggtgggaagctggactaggta
ggttcttacggggtggagaggactgggtgaagggaagcgctctcacagctgacttctatt
gagtggcacttgtgaagtgtggagaactaagttcttttcatggctgaacttgttaatcct
catgatgaactgtgaggcaggtgctgttattagccccattttccagatgaagaaactgag
tctcagagaagctgagctgatgtagctaggaagtgacatc >IGR3556a
gactgggtgaagggaagcgctctcacagctgacttctattgagtggcacttgtgaagtgt
ggagaactaagttcttttcatggctgaacttgttaatcctcatgatgaactgtgaggcag
gtgctgttattagccccattttccagatgaagaaactgagtctcagagaagctgagctga
tgtagctaggaagtgacatcactgggactgagataagcagaacagtccaacccagaggct
gagcaccccctgggcagcatcggacaatgacggccttaaaggatgatgccatgtggcagg
aggggacagcagggtgaggatgagatgtaaccactctgattactgacggggagatccctg
aggcctctggcggagtagtttcagtgtatggtggggcaaagcctctggcagtgggctgag
aagcgagtgacggtgagacggagggtagaagattctttgaagtttttattttgaaggaaag
agggggatggggcagccagaggagtcacagggtcagagacgcaccttccacacagaagtt
tgagctccttcctctcttaaggaggtgagccgggaatgggtgagatggctggccggccag
cacaggcagagcccaccatcagctgtcacgggctcctcgcagagagctcagggaagggc
tgcctggtggcccagtccatctgggtggggtaggtgcag >IGR3557a
ggagtcacagggtcagagacgcaccttccacacagaagtttgagctccttcctctcttaa
ggaggtgagccgggaatgggtgagatggctggccggccagcacaggcagagcccaccat
cagctgtcacgggctcctcgcagagagctcagggaagggctgcctggtggcccagtcca
tctgggtggggtaggtgcagtggggtgggcctggttggtccacaggtttgtggtgggagg
ggacaatggcttctgtgttctctgtgaaatagaggtcaagtcagccctgaggtggggct
agaagcaataagggtggtgaggtttggtggcttgagctgtgactacctggaggtgacctt
gaggggctggcagcctgggtcagagggcgaggaggttgggaggacccagggccttggca TABLE 5-continued ggcaagaatatggaatggaaggccccagaggcagggagtggggccatgggaggaggctgg
gatgggcagggaggccagctgggcagagcaaaggaggcaggaggtggtgcagccccggac
cccggagaggcccagtgactgcagcccaatacctgctgccgttcgatgaaccagggagga
atggagggacatgttcctaaaagcaaacctcattccaaaggggctgccaaggatatctgg
gtagttggccaccacagcgcttcngtgagcccttggaccg >IGR3558a
gggcagagcaaaggaggcaggaggtggtgcagccccggaccccggagaggcccagtgact
gcagcccaatacctgctgccgttcgatgaaccagggaggaatggagggacatgttcctaa
aagcaaacctcattccaaaggggctgccaaggatatctgggtagttggccaccacagcgc
ttcngtgagcccttggaccgaggcatagcctgggtcatcctgggggtctccttcaaggtt
tgccttgactctataggagcttcatgcaaaatcatgggcaccacttccctcctcagagg
cgacagtcctgccagcccttgaggagagacctggtcccctgtaagatggtgattccaccc
caggcctttgtgtcaacccagcccggcttaggggaaacctcctttgtgggctgggctgat
tgctatcaagaaggaaatgagcacacgtgcccacccctggggcaggcatgagggagggt
gtgccagggcccggacaggagagccagcccaagactgcagcccagggtctgccaaagccc
tggaggtttcaggaggggtctctggacccctgtctaatggatccctgtgggcctgacccn
ncccctnnngnnnnggncacnttgttggaagtcctggccctcanggtccagtccaactaga
ggtacatgcctccttcttcccatcactcaccccacaggc >IGR3559a
gagccagcccaagactgcagcccagggtctgccaaagccctggaggtttcaggaggggtc
tctggacccctgtctaatggatccctgtgggcctgacccnncccctnnngnnnnggncacn
ttgttggaagtcctggccctcanggtccagtccaactagaggtacatgcctccttcttcc
catcactcaccccacaggcctagtggaattttctggggtacccgccacaggcaagaacc
tgggcctcagtcactgtgacaagtcctccgccaccctttccatggcatcacaagtgtca
gatttaatctgcccatgacctcggttgtatttccgctggtggccctgatgacatcgcctg
gttttgtcaccacaaangcagctcagggttcttggccagccaagcagtgcaaccagatgt
cccctgctcacctgagcagagagctcaggaaaaagccaccgagcgggcccagctggagag
ccctggcctcctgtcccaancnngntctgcactccatccccaagacctacacagcctcca
cctgtgcaccctcgcctttctattccctgctgcagggtcatggcttccttggggcccagt
cggngcagagcagaccctccatcccaggcccagtctaatagagaagacagttggagaatc
cccatttagaatgatatgcctgtgggagacagaagcccag >IGR3560a
cnngntctgcactccatccccaagacctacacagcctccacctgtgcaccctcgcctttc
tattccctgctgcagggtcatggcttccttggggcccagtcggngcagagcagaccctcc
atcccaggcccagtctaatagagaagacagttggagaatcccatttagaatgatatgcc
tgtgggagacagaagcccagaaatgaggcagcctcatccagcctgcaccatcagagaaga
caggaggaaaggacagctatgacctaaaggatgatctggagccaggcaagccacagaaga
agtgttccctagggagtgctgggttttgggggctgcaggtgctccatctgttggcctcaatc
cagggctccaatatctggatacctggggtggccatatggttcctattgttattaataagt
tatgggcttttcagtgtctgtcactctcttgttacccacctgaaatacaaagctttggaag
atgcattcctattgcatttatcatatctatcgcagacaaaaccaagagctccccgttctc
aaagaagctgccccaaactgtgaggtgacaaggttgggcataaatgctaagaacctgg
cagtccaggccctcaggaaatgctctcttaagtgggggagacttcacatggagcattagt
tgtgtagatgatgttgccatgcgaagtcttgtctgcctcc >IGR3561a
tcatatctatcgcagacaaaaccaagagctccccgttctcaaagaagctgccccccaaact
gtgaggtgacaaggttgggcataaatgctaagaacctggcagtccaggccctcaggaaa
tgctctcttaagtgggggagacttcacatggagcattagttgtgtagatgatgttgccat
gcgaagtcttgtctgcctcccaggagagaggggaagggccggcctgggtgggcagctgc
aggtcagagctgtccagggaaggacaggaccagatgctagctaggcaggggcacagacag
acccaggtgagctcagagccaggctgcctctcagccgtgcctgctctgtcttatcttcct
tggtgaggtgaggagaaaccttttacattgtttccagccttactgatcttttctttacag
aaaatgatgaataagttgatgtgtttgtcgtggaggttccatatcagaaaagagtatcag
tccactgggcttctccccacacctcatcatcccccccaaccccacaccccctgaatct
cctgcaccgccctcacccgtgctgggccttttacagaggatgtgggccaggccacttcaga
tccacacaggttagggaagaccacggtacctccaagcagtacagatatgtggagaccgtt
ttgcctcccctcctcctcatccttcttcctctcagcctc >IGR3562a
cacctcatcatcccccccaaccccacaccccctgaatctcctgcaccgccctcacccgt
gctgggccttttacagaggatgtgggccaggccacttcagatccacacaggttagggaaga
ccacggtacctccaagcagtacagatatgtggagaccgttttgcctcccctcctcctca
tccttcttcctctcagcctccaaaagcccctacccacaatggccattagaatccagacta
aagacaacttcttgaacatcatccttgaaatccagtggcaactgagcacgccctctatga
gtagctggtgccagatgggcacagggtaggaacagctccgctcggccccaggccaggcac TABLE 5-continued tcatgggttcttgctcttccctgcagaaaggtgagatccaggagcaatggatcctgagg
tgggcacacagccccgaagtcccactgccctccctaccagtcgtcactgccattgtattg
ctggtcactgctctgggcttgggcacatttgggtgaggcgcacctgcagggtcacactgg
agtcagcctttatctggcatcttcactgcagatgcatccaccagccattctttgcctca
tggaggatgtgcgtggtagatgttctttgccaagtgtgggagttgtaatattcacattgg
cacagctggcttccttcttttttgcatcctggaagctggtt >IGR3563a
gggcacatttgggtgaggcgcacctgcagggtcacactggagtcagcctttatctggcat
cttcactgcagatgcatccaccagccattctttgcctcatggaggatgtgcgtggtaga
tgttctttgccaagtgtgggagttgtaatattcacattggcacagctggcttccttcttt
ttgcatcctggaagctggttcagaaagtgcccgtatacccccaggcccttgcccagtgcat
ctggagccaggaggcatgatggtccctgccctgccggcctgtgtcagactgtgctgtgac
ccgcttggctgctgtgctcctaaagcagctgggttcctcctggggcctgggcaggacaga
gctggggaggtgatgggggaactagtgaaggccaccccagaaaggaggcagggggaatgg
caaacaaggccacaaggacagcccttcctggccgtaccacacacacttggcccctgtaga
acaccacctttctgaagcctaacctggctgccttactgaacacctcaaagctctttaaac
ctcatcttctttatccatttggaacaatccaaagatgattgaggtgtgtgaggctgggga
gcgtccctctgtcactggagtctctgtgttcccagaagagcccgttccgggtcaaagtac
ctgcccttgtcctgcccttcccaaacaggaacagcattt >IGR3564a
aacctggctgccttactgaacacctcaaagctctttaaacctcatcttctttatccattt
ggaacaatccaaagatgattgaggtgtgtgaggctggggagcgtccctctgtcactggag
tctctgtgttcccagaagagcccgttccgggtcaaagtacctgcccttgtcctgcccttt
cccaaacaggaacagcatttccactccacctctgcccccccaggttcttccccctctccact
gccagcagcccctccagggctgggccagggccaccacccaggaccttctcagtcttttca
aaaggccctcctggtctatttggcttccagaagctgactggcctcttttgtctctggccc
acaggaactcctgcaaaccttgccatctccacacctacaccccagggaagctgccacct
gggctgggatgcccactgccccaggctgagcaaggtacctgccacgaccttccaccttc
tctacacctgacccaatgttctggtttcttcaagggaaaaacagcggctgcacatcgaag
aaagcaattctaataacttgttgaatagcttcccgagaaccctgggtgatgttgggctct
tgctaccaaccaaatctctcatgccttttgttcaggctcttgaactcccaggcctgagagc
tgggctcaggtcctgggtcaccaatattccttctcgatat >IGR3565a
ctggtttcttcaagggaaaaacagcggctgcacatcgaagaaagcaattctaataacttg
ttgaatagcttcccgagaaccctgggtgatgttgggctcttgctaccaaccaaatctctc
atgccttttgttcaggctcttgaactcccaggcctgagagctgggctcaggtcctgggtca
ccaatattccttctcgatatcccaggaatactccactccttgttacagacgttggcagtt
gaaagtttagctctggaatgagccgctcagttttcatcttggggatactgacaatcatgt
gtatttatgttgcagattacttaacggttattcactttgttgtgaaaatattttatttta
ttaagggagccctcttaggagcctctgagcagagctcagagcgggtacgagagcatctac
atttctctctcaggtttcagtaaattccttctcctctgggaaagtgagcactttgtagag
ggtccctttgtcagcagtgctgcatttctagaaggcttctccattttgacttgggtctggg
ttgcaatttccacactccacagttaa >IGR2312a
cactgcaacctctgcctcctgggtcaagcagttctcctgcctcagcctcc[tgagtagctg
ggattacatgngactgccaccacacccagctaatttttttgtattttttagtaaagatgagg
tttcactatgttggccaggctggtctcaaattcctgacctcaggtgatccacctgcctca
gccncncnnanngnnnngnnnnnannngngnnnnncnnngtgcccagccaacaatatgct
ttattatctgatagagctagtctctacttattactcttctatttcagaaccttcctagct
attcttccatgcttattctccctaaggcattttggtatcattttgttaaaagtcctactt
accatttcactttctgcatctgctctaaggtttctggaagagtcattcccaaactttcag
ggaaaaaagggtgaagattccaatcaggacagtcagactacccatgacgatgtagggca
gcattctgttgtaagcacctgtaaagcccgggacataagaacatcaatcagataggagga
ctctctgggcactcttgagcatcattttgtgaagttggtgaacagtataagagaatggat
ttaaatctgaacattttcagagaaaaaaaagtaagcaaaatatcagtttc]tttttggcag
atgacattgtgcatgtctataatcctttttgcattatcata >IGR2313a
gtaaagcccgggacataagaacatcaatcagataggaggactctctgggc[actcttgagc
atcattttgtgaagttggtgaacagtataagagaatggatttaaatctgaacattttcag
agaaaaaaaagtaagcaaaatatcagtttcttttttggcagatgacattgtgcatgtctat
aatcctttttgcattatcataaggcttttcattcttcctgtcaactggtatcctctaagc
tactactcagtcatgtgtgacagatgttcctttggtagagttctttgcctaccagagttc TABLE 5-continued tcctcttaaggtggaggtaattggaaatgggggatgggaggacatcaaggagaaggaggt
taaccaggatgtttcagggataggttttggcnatgataggtctggcatgactctgctttt
gcccaaactagtaggctgcagtggaaagttaggtccacagggctatgagactcaaaaaaa
aaaaaaaaaaaaaaaaaaacaactaagtattatgttcacttcagattaaatcagtaaatt
ataagtatcaggcacattctgtaaaggcactgtgtgcctggatttggcttcttttttggag
cacttacatgtcttgggttaatatgtaatctctttgtgaagctttactca]cacaggagaa
aaacagatcctcatcttgctttgccccctgtatacatacag >IGR2314a
aactaagtattatgttcacttcagattaaatcagtaaattataagtatca[ggcacattct
gtaaaggcactgtgtgcctggatttggcttcttttggagcacttacatgtcttgggtta
atatgtaatctctttgtgaagctttactcacacaggagaaaaacagatcctcatcttgct
ttgccccctgtatacatacagagcttacagaggaacagcacacccatggatttcatttgac
ccaaaacataaggaaaatattgttattgcagcttctctgaggcctctgtgtcactaacag
gagtagctgtgtggagtaggagactcttggactccctgtcttatgtaccagtgtctgacc
actggaccatctgagcatagtttgaaatagtttgaaagtacagggaaggacaaagggaaa
ataacaccactctgtataatctgctatctcaggtgtggcacagggcaactgtgcagaat
atgtttgttaggaaaatgtttctcttctctgtaagggtttggattataccctttcctgag
aattcatacatgtttcaggtgtgtgtgtgtgtgtgtgtgtgtgtgtacgtgtgtaccag
taggtaaccaattgcccaattgatgaggtgtgtctgcatttctcaccagt]agagtcctta
atgaggaccaggcatggggtgtcagatcctacatcagatt >IGR2315a
tctctttctctgtaagggtttggattataccctttcctgagaattcataca[tgttttcagg
tgtgtgtgtgtgtgtgtgtgtgtgtacgtgtgtaccagtaggtaaccaattgcccaat
tgatgaggtgtgtctgcatttctcaccagtagagtccttaatgaggaccaggcatgggt
gtcagatcctacatcagattgaacatgccgctgaaacacctctgtagtttcatttcgat
tgacacctttgagtatataaaaactaaaattgtcttcattacaaagatatcataaagtga
aaatacaaatggtaaactaggaaaaatatttacaacatatatacaagggggctaatttctt
ccattgcaaagagtttgcacaagtcaaaaagaaaaagatgaatacacctgttgcaggaag
ttagggaccccgaaaggagggactggctgaagccatggcagaagaatgtggattgtgaag
atttcatggacatttattagttccccaaattaatacttttataatttcttacgcctgtct
ttactgcaatctctgaacataaattgtgaagatttcatggacacttatcacttccccaat
caacaccccttgtgatttcctatgcctgtctttaatctcttaatcccgtca]tcttcataag
ctgaggaggatgtatgtcgcctcaggaccctgtgatgatt >IGR2316a
ttccccaaattaatacttttataatttcttacgcctgtctttactgcaat[ctctgaacat
aaattgtgaagatttcatggacacttatcacttccccaatcaacaccccttgtgatttcct
atgcctgtctttaatctcttaatcccgtcatcttcataagctgaggaggatgtatgtcgc
ctcaggaccctgtgatgattgcgttaactgcacaaattgtttgtagagcatgtgtgtttg
aacaatacgaaatctgggcaccttgaaaaaagaacaggataacagcaatgttcagggaac
aagagagataaccttaaactctgaccgctggtgagtcgggcagaacagagccatatttct
cttctttcaaaagtaaatgggagaaatatcgctgaattcttttttctcagcaaggaacatc
cctgagaaagacaattcgtccctgagggtaggcctctaaaatggccactttgggggcagc
tgtcttttacggttgnagctgtagggatgaaataagccccagtctcccgtagcactccca
ggcttgttaggatgaggaaattcccacctaataaattttggtcagaccggttgtctgctc
tcaaaccctgtttcctgataagatgttatcaatgacaatgcgtgcccaaa]acttcattag
caattttaattttgccccggtcctgtggtcctgtgatctc >IGR2317a
gtagggatgaaataagccccagtctcccgtagcactcccaggcttgttag[gatgaggaaa
ttcccacctaataaattttggtcagaccggttgtctgctctcaaaccctgtttcctgata
agatgttatcaatgacaatgcgtgcccaaaacttcattagcaattttaattttgccccgg
tcctgtggtcctgtgatctcaccctgcctccatttgccttgtgatattctattaccttgt
gaagcacgtgatctctgtgacctacacccctattcgtacactccctccccttttgaaatca
ctaataaaaacttgctggttttatggctcaggggcatcatggaacctgccaatatgtga
tgtctccccccggacacctagctttaaaatttctctctttttgtactctgtccctttattc
tcagaccagctggcacttagggaaaatagaaaagaanccatgtgaattatcagggctga
attttgcccgatatacaccattaaagaatgggcaaagaaggccaggcacagtggctcatg
tcttgttatcccagcactttgggaggccaaggcaggtggatcacctgaggtcaggggtttg
agaccagcctgaccaatatgatgaaacccatctctactaaaaatacaaa]aaaaaanaaa
aaattagccggacatggtggcatgcgcctgtagtcccagc >IGR2318a
ttaaagaatgggcaaagaaggccaggcacagtggctcatgtctgttatcc[cagcactttg
ggaggccaaggcaggtggatcacctgaggtcaggggtttgagaccagcctgaccaatatg
atgaaacccatctctactaaaaatacaaaaaaaaanaaaaaattagccggacatggtgg
catgcgcctgtagtcccagcaactcaggaggttgaggcaggagaattgattgaacccagg

TABLE 5-continued

```
cggcggaggttgcagtgagctgagattgcgccactgtanctccagcctgggtgacagagt
gagactccatctccaaaaaaaaaaaaggggcaaagaacatgagcagtcagttcactgaa
aaataaataaaatggccaaaaaatacacaaaaacatgctcaacctcattcataattaata
aataggaatgaaagtaacaatgatatccattttcacataacagataaccaatgattaaa
aaattaggccaggtgctgtggctcaaacctgtaatcccagcactttgggaggttgaggcg
ggtggatcacttgagcccaggagttngaaaccagcctgggcaaactggcaaaatcccgtc
tntaccagaaaaaaaaaaaaattagctgggcttgacggtgtgcatgcctg]tagttccagc
tagttgggagtctgaggtgggaggatctcttgagcctggg >IGR2319a
gctcaaacctgtaatcccagcactttgggaggttgaggcgggtggatcac[ttgagcccag
gagttngaaaccagcctgggcaaactggcaaaatcccgtctntaccagaaaaaaaaaaaa
attagctgggcttgacggtgtgcatgcctgtagttccagctagttgggagtctgaggtgg
gaggatctcttgagcctgggggattgaggctgcagtgagctgggaatctaggatcgcacc
actacactccagagtgagaccctgtctcagaaaaaaaaaaaaaaaaaagaattaggtaat
ctttattgttggtgagattattgaaaaccactcttacctattaataattagattataatt
ggcacaatatgtagagttcaatttgggaatatctatgaaattttttaatggctctctttg
ctccaggaattttacttctatgaatctacctgtaaatccaaatatacgtaagtaaattca
caaagggtgtaggagcataggnagaatgttcgttgtaatgnttatttgtaatagcaaaaa
cctggaaatgacctacatgtcctccattcattggagcctggttaaataaattatgtgttt
cnagtataaaagtaagattttncattgtgaaaacttcaaatggcatggaa]tgtactggaa
aaaagtacaagttcacctcccctctcccaggaggatccct >IGR2320a
gnagaatgttcgttgtaatgnttatttgtaatagcaaaaacctggaaatg[acctacatgt
cctccattcattggagcctggttaaataaattatgtgtttcnagtataaaagtaagattt
tncattgtgaaaacttcaaatggcatggaatgtactggaaaaaagtacaagttcacctcc
cctctcccaggaggatccctagaaaaccaacatgaactgtttggtgagtagccctacaga
cattttgttttgcacaacattatgtacacacacacatatatatataattttttanacggc
actctttgctccaggaattttacttctgtgaatctatctgtagattatacttacatatac
ttattttaaaatgtacttatatacattttaaaaggaggtacctatttaaaaagaaggta
aaggagcaatatgtaactatttggaaggatattctgatacaatgttaagtttaaaaagtt
ttaacatatataatgttatttgtgtgttttattcttttattttttattattttttatttat
ttttgagacagagtttttgctnttgttgcccaggttggagtgcagtggtgcaatcttgact
cactgcagcctctgcctcctgggttcaagcaattctcctacctcagcctc]cagagtagcc
gggattacaggcacctgccagcacacctggctaatttttt >IGR2321a
tgtgtgtttattctttttatttttattattttttatttattttttgagaca[gagttttgct
nttgttgcccaggttggagtgcagtggtgcaatcttgactcactgcagcctctgcctcct
gggttcaagcaattctcctacctcagcctccagagtagccgggattacaggcacctgcca
gcacacctggctaatttttttattttagtagagacagggtttcaccatgctggccaggc
tggtcttgaactcctggcctcaggtgatccacctaccttggcctnccaaagtgctgggat
tacatgcntgagccaccacgcctgagttgcnngtgtgtttaaaaaattatatacatacnt
gngnacatgatgtngtgcaaaacaaantgtctgnancnctactcaccagtttgngatngg
ctttctagagctcctcctgggagaggagaggngaacttgtactttnttccngtacattc
tatgctatttgacgttttcacaatgaaaatcttacttttancattgaaaactaatttaaa
ggaagaacaaatgcacaagatgcagctcaccgaggtaaacaaagtagggggcaatgatgc
tgcccactctggaggccgtggatgtgacccccaccgccatgttcctgacc]agggttgggt
agagctcagcagtgaagacatacagcatggagaaagcaga
```

From the foregoing, it is apparent that the invention includes a number of general uses that can be expressed concisely as follows. The invention provides for the use of any of the nucleic acid molecules described herein in the diagnosis or monitoring of diseases, particularly IBD, such as in the genotyping of samples from individuals to be tested. The invention further provides for the use of any of the nucleic acid molecules in the manufacture of a medicament for the treatment or prophylaxis of such diseases. The invention further provides for the use of any of the nucleic acid molecules as a pharmaceutical.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (2358 sequences)

SEQ ID NO: 1 - DNA, 45 bp, Homo sapiens
  misc_feature (1)...(45): n = A,T,C or G
aaacttcctgtgcaacccagantatcacctttgaaagtttcaaag

SEQ ID NO: 2 - DNA, 57 bp, Homo sapiens
  misc_feature (1)...(57): n = A,T,C or G
atttccttccccttgtgataatgtctctcgtnataaggatcctggagtgactcaagc

SEQ ID NO: 3 - DNA, 66 bp, Homo sapiens
  misc_feature (1)...(66): n = A,T,C or G
acacgcataggaaactccttccagagggttttcncctgtctctgtaggaaggggggccccagaggg

SEQ ID NO: 4 - DNA, 53 bp, Homo sapiens
  misc_feature (1)...(53): n = A,T,C or G
aaaggaaacttcctgtgcaacccagantatcacctttgaaagtttcaaagaga

SEQ ID NO: 5 - DNA, 47 bp, Homo sapiens
  misc_feature (1)...(47): n = A,T,C or G
ctgggaacccaaacatcctggagaanagctgagaacctaccaaggga

SEQ ID NO: 6 - DNA, 59 bp, Homo sapiens
  misc_feature (1)...(59): n = A,T,C or G
agacagaaaattagcttagagatgggaggtggcangatctctaaagctgtcccgctgcc

SEQ ID NO: 7 - DNA, 62 bp, Homo sapiens
  misc_feature (1)...(62): n = A,T,C or G
atgggaggtggcacgatctctaaagctgtccngctgccattcaggagtgcctcatgcataag

SEQ ID NO: 8 - DNA, 51 bp, Homo sapiens
  misc_feature (1)...(51): n = A,T,C or G
ggctacttgaaagatccagacaggangaaggaggccctggacagcgatggc

SEQ ID NO: 9 - DNA, 53 bp, Homo sapiens
  misc_feature (1)...(53): n = A,T,C or G
accagggagcctgtgctaccactgctaanggctctaccaccacccggcttctc

SEQ ID NO: 10 - DNA, 32 bp, Homo sapiens
  misc_feature (1)...(32): n = A,T,C or G
agaagcagtagggcnactactaggtagcccca

SEQ ID NO: 11 - DNA, 30 bp, Homo sapiens
  misc_feature (1)...(30): n = A,T,C or G
gggtgtgacagaggctgtntggcaggactc

SEQ ID NO: 12 - DNA, 28 bp, Homo sapiens
  misc_feature (1)...(28): n = A,T,C or G
ggcgcccacncaaactctgtcgcagtcc

SEQ ID NO: 13 - DNA, 29 bp, Homo sapiens
  misc_feature (1)...(29): n = A,T,C or G
aggcccagccctnttccttactatgtcct

SEQ ID NO: 14 - DNA, 56 bp, Homo sapiens
  misc_feature (1)...(56): n = A,T,C or G
tagaagcagaaggtggttgtggcctcnctggtgtgggactttctgccccactgcac

SEQ ID NO: 15 - DNA, 63 bp, Homo sapiens
  misc_feature (1)...(63): n = A,T,C or G
tcatggcggggtgtctgtgacctgagagaggntcagatggaagaagcctgggtgaggaatgag

SEQ ID NO: 16 - DNA, 48 bp, Homo sapiens
  misc_feature (1)...(48): n = A,T,C or G
aaggccctcattgattcatgattangtggtttgttgttgtccatgcct

SEQ ID NO: 17 - DNA, 40 bp, Homo sapiens
gctccaagccctggggagggaaggaagtggctgaccccac

SEQ ID NO: 18 - DNA, 69 bp, Homo sapiens
  misc_feature (1)...(69): n = A,T,C or G
ctttcatgtagaaagagctagtagtacttgattntataatgcttaccatgtccatatgaacaagcttcc

SEQ ID NO: 19 - DNA, 52 bp, Homo sapiens
  misc_feature (1)...(52): n = A,T,C or G
tccttcctcacaaactcctaagtacccngagagcaataggactcctgttaaa

SEQ ID NO: 20 - DNA, 48 bp, Homo sapiens
  misc_feature (1)...(48): n = A,T,C or G
gggttttgtgtatctaaaataggngacctcagccttaaaacctcatct

SEQ ID NO: 21 - DNA, 50 bp, Homo sapiens
  misc_feature (1)...(50): n = A,T,C or G
tggaaaaatcaattacccctgtattacntgtgtggagaaatgaaggcatt

SEQ ID NO: 22 - DNA, 23 bp, Homo sapiens
cagtaaatatytaggcctatgtc

SEQ ID NO: 23 - DNA, 62 bp, Homo sapiens
  misc_feature (1)...(62): n = A,T,C or G
aatttatttatttgcttttaaataagtganctctctgctcatttggattctgctatctcgta

SEQ ID NO: 24 - DNA, 59 bp, Homo sapiens
  misc_feature (1)...(59): n = A,T,C or G
ttatttatttgcttttaaataagtgactctnctgctcatttggattctgctatctcgta

SEQ ID NO: 25 - DNA, 59 bp, Homo sapiens
  misc_feature (1)...(59): n = A,T,C or G
gcaatgctgtttttttctttagtatacaaantgaatccttctttccctcaaaagcttga

SEQ ID NO: 26 - DNA, 59 bp, Homo sapiens
  misc_feature (1)...(59): n = A,T,C or G
cccccaccatctctcggtgggcgaaggganaatggtatctttaataccaaaaagataat

SEQ ID NO: 27 - DNA, 59 bp, Homo sapiens
  misc_feature (1)...(59): n = A,T,C or G
atctttgaggctttatgaaccacatatggtngaaaacattgttggcctcctggcacaga

SEQ ID NO: 28 - DNA, 42 bp, Homo sapiens
  misc_feature (1)...(42): n = A,T,C or G
ccatctatgtaggtaacngaggcaaagcaagggctagggaga

SEQ ID NO: 29 - DNA, 58 bp, Homo sapiens
  misc_feature (1)...(58): n = A,T,C or G
gggaggcagacattaggcaaataatnacatggatctctgaaaaacatagctcctacga

SEQ ID NO: 30 - DNA, 50 bp, Homo sapiens
  misc_feature (1)...(50): n = A,T,C or G
agaggaatggggtggagttggcagnggggctggttctcggctctccccga

SEQ ID NO: 31 - DNA, 50 bp, Homo sapiens
  misc_feature (1)...(50): n = A,T,C or G
ctggcttaggccaaagaactggccangttacagttcccacagagtacccg

SEQ ID NO: 32 - DNA, 53 bp, Homo sapiens
  misc_feature (1)...(53): n = A,T,C or G
agggtgagtgaggtgtactagggantctggacactgagcccctgaagttgggg

SEQ ID NO: 33 - DNA, 45 bp, Homo sapiens
  misc_feature (1)...(45): n = A,T,C or G
gcggctgcagggggaggcacaagcntgggccaggcgccaagcggc

SEQ ID NO: 34 - DNA, 29 bp, Homo sapiens
atgtgctaccatggccaactaatgtttga

SEQ ID NO: 35 - DNA, 61 bp, Homo sapiens
  misc_feature (1)...(61): n = A,T,C or G
ctgggtaaaacaggctgccctggacaaagcnggaaacagaatgaggctccaggcgttgatt

SEQ ID NO: 36 - DNA, 60 bp, Homo sapiens
  misc_feature (1)...(60): n = A,T,C or G
ccacattttcttaatccagtctatcattgntggacatttgggttggttccaagtctttgc

SEQ ID NO: 37 - DNA, 60 bp, Homo sapiens
  misc_feature (1)...(60): n = A,T,C or G
tccttcacaggacaggaattctgcaaaanaaacatttcattagcttgcattggtaagcat

SEQ ID NO: 38 - DNA, 57 bp, Homo sapiens
  misc_feature (1)...(57): n = A,T,C or G
aaatggttactgtataccattacctatctgctttnggggtgggtggcgcggggggga

SEQ ID NO: 39 - DNA, 62 bp, Homo sapiens
  misc_feature (1)...(62): n = A,T,C or G
aataggtgtcgatttgcagtgacaatgtgagncaattagtttatcaggagaagctaacgatg

SEQ ID NO: 40 - DNA, 61 bp, Homo sapiens
  misc_feature (1)...(61): n = A,T,C or G
tgaactttagctctctttggtaaataggaaatngctccaactacttgtccacccaagaaac

SEQ ID NO: 41 - DNA, 63 bp, Homo sapiens
  misc_feature (1)...(63): n = A,T,C or G
tatctgccgccctcccctccacagcttgtcagncttcatctaattggaaaagccagatgctcg

SEQ ID NO: 42 - DNA, 67 bp, Homo sapiens
  misc_feature (1)...(67): n = A,T,C or G
tcccctccccttgtttcgtcccgatctctgttcncatcttatctcatggggaggatttctccaacct

SEQ ID NO: 43 - DNA, 62 bp, Homo sapiens
  misc_feature (1)...(62): n = A,T,C or G
ctctttgctaacatatttaatatttaaatacnaggaaaaacaataaattactcgttggctga

SEQ ID NO: 44 - DNA, 52 bp, Homo sapiens
  misc_feature (1)...(52): n = A,T,C or G
atgtcgccttttcctgctcttccctcnttttcctagaagtcctccagaaacc

SEQ ID NO: 45 - DNA, 57 bp, Homo sapiens
  misc_feature (1)...(57): n = A,T,C or G
ctggagtgccgctacttggccgtgtgaccccnctacgggcctgtttcctaatctgta

SEQ ID NO: 46 - DNA, 64 bp, Homo sapiens
  misc_feature (1)...(64): n = A,T,C or G
ataatgcagaacaaattagagaaaaactccngtcaggctctccactcacccatggctggtggct

SEQ ID NO: 47 - DNA, 57 bp, Homo sapiens
  misc_feature (1)...(57): n = A,T,C or G
aaacaaacaatgcccggcagagtcaccngggctggccatttgaaaagagtacatcag

SEQ ID NO: 48 - DNA, 58 bp, Homo sapiens
  misc_feature (1)...(58): n = A,T,C or G
gggagggctcctggaacccagagagaccngtaggaggggactgccggcaggagctgtg

SEQ ID NO: 49 - DNA, 63 bp, Homo sapiens
  misc_feature (1)...(63): n = A,T,C or G
gcggcatctccatccttccaatgaacttgagcntgagcaatgaacttgagtgtacagtctcat

SEQ ID NO: 50 - DNA, 63 bp, Homo sapiens
  misc_feature (1)...(63): n = A,T,C or G
tactttatcttcaattcgcagttggttgaaaaantctgcaaatacgtagccctcccagttcaa

SEQ ID NO: 51 - DNA, 65 bp, Homo sapiens
  misc_feature (1)...(65): n = A,T,C or G
cagtagtgctaggaaagagatgtggattactgcntctgtgcaatgataaagcagtaagttatccg

SEQ ID NO: 52 - DNA, 56 bp, Homo sapiens
  misc_feature (1)...(56): n = A,T,C or G
tgtagtaaaaacattcaaaatcctctcttcnagctatcaagttattttgtaatttg

SEQ ID NO: 53 - DNA, 61 bp, Homo sapiens
  misc_feature (1)...(61): n = A,T,C or G
ctaaactggggtcatatttcctcatcagccncattctgctaatgccagatgccctgggaag

SEQ ID NO: 54 - DNA, 57 bp, Homo sapiens
  misc_feature (1)...(57): n = A,T,C or G
tctgctaatgccagatgccctgggaagntcttcactgccatcttggaaggatgcaga

SEQ ID NO: 55 - DNA, 49 bp, Homo sapiens
  misc_feature (1)...(49): n = A,T,C or G
cctgggaagatcttcactgccatcntggaaggatgcagaatgtggtgat

SEQ ID NO: 56 - DNA, 59 bp, Homo sapiens
  misc_feature (1)...(59): n = A,T,C or G
ctgctcccatcttccctataccatgtctgancccttgagccataacatggatggacagc

SEQ ID NO: 57 - DNA, 54 bp, Homo sapiens
  misc_feature (1)...(54): n = A,T,C or G
aagctacacaagatgggcatttggcctttnaccaacatgcttgttccttgactt

SEQ ID NO: 58 - DNA, 61 bp, Homo sapiens
  misc_feature (1)...(61): n = A,T,C or G
cagcaaaccccatgcaaacattcagcatttcanggctgaggccacacacagaagccatcag

SEQ ID NO: 59 - DNA, 52 bp, Homo sapiens
  misc_feature (1)...(52): n = A,T,C or G
aaaccccatgcaaacattcagcatttcacngctgaggccacacacagaagcc

SEQ ID NO: 60 - DNA, 57 bp, Homo sapiens
  misc_feature (1)...(57): n = A,T,C or G
ggtagcccacagatgtttctgtggctaccaacngagaaaagccatcttttaaacagc

SEQ ID NO: 61 - DNA, 69 bp, Homo sapiens
  misc_feature (1)...(69): n = A,T,C or G
gccatcttttaaacagcagaaatctcactcgttcncctgtcccactctctccctgtcaatccccaggac

SEQ ID NO: 62 - DNA, 64 bp, Homo sapiens
  misc_feature (1)...(64): n = A,T,C or G
ccatctgagacctcatcagccacgccttcactttccanatcaccatcagcattctggttacaac

SEQ ID NO: 63 - DNA, 38 bp, Homo sapiens
  misc_feature (1)...(38): n = A,T,C or G
ggggcttgcgcagcactgggccngggacgcagacccaa

SEQ ID NO: 64 - DNA, 52 bp, Homo sapiens
  misc_feature (1)...(52): n = A,T,C or G
cagcactgggccggggacgcagacccaanacgacagcaggcagcgccgagcg

SEQ ID NO: 65 - DNA, 29 bp, Homo sapiens
tggaaggggccgacatggcaatgaatcta

SEQ ID NO: 66 - DNA, 27 bp, Homo sapiens
  misc_feature (1)...(27): n = A,T,C or G
cccaggttggtttngaactcctggctt

SEQ ID NO: 67 - DNA, 24 bp, Homo sapiens
  misc_feature (1)...(24): n = A,T,C or G
actgctgggccgngtgtggtggct

SEQ ID NO: 68 - DNA, 27 bp, Homo sapiens
  misc_feature (1)...(27): n = A,T,C or G
gctgggccgggtgnggtggctcacccc

SEQ ID NO: 69 - DNA, 26 bp, Homo sapiens
  misc_feature (1)...(26): n = A,T,C or G
aggcaggtggatcacnaggtcaagga

SEQ ID NO: 70 - DNA, 19 bp, Homo sapiens
  misc_feature (1)...(19): n = A,T,C or G
gtaaaatttantttttttt

SEQ ID NO: 71 - DNA, 23 bp, Homo sapiens
  misc_feature (1)...(23): n = A,T,C or G
ttagaaaaacnactgctgggccg

SEQ ID NO: 72 - DNA, 31 bp, Homo sapiens
  misc_feature (1)...(31): n = A,T,C or G
ctcagaaaaacaaaacanaacaaaaagaaac

SEQ ID NO: 73 - DNA, 25 bp, Homo sapiens
  misc_feature (1)...(25): n = A,T,C or G
taaaaatttaanttttttttttttt

SEQ ID NO: 74 - DNA, 22 bp, Homo sapiens
  misc_feature (1)...(22): n = A,T,C or G
aaaaanaaacaacactttagag

SEQ ID NO: 75 - DNA, 30 bp, Homo sapiens
  misc_feature (1)...(30): n = A,T,C or G
aactcctgacctaangtgatccgcctgctt

SEQ ID NO: 76 - DNA, 23 bp, Homo sapiens
  misc_feature (1)...(23): n = A,T,C or G
gtttttttttntttgagacagaa

SEQ ID NO: 77 - DNA, 26 bp, Homo sapiens
  misc_feature (1)...(26): n = A,T,C or G
tttcctttaccatnctgtcctcatat

SEQ ID NO: 78 - DNA, 24 bp, Homo sapiens
  misc_feature (1)...(24): n = A,T,C or G
ccatcctgtcntcatatacaaact

SEQ ID NO: 79 - DNA, 23 bp, Homo sapiens
  misc_feature (1)...(23): n = A,T,C or G
tggttgcttctacnttttttttt

SEQ ID NO: 80 - DNA, 25 bp, Homo sapiens
  misc_feature (1)...(25): n = A,T,C or G
tatttttgcctcngtggattctcct

SEQ ID NO: 81 - DNA, 26 bp, Homo sapiens
  misc_feature (1)...(26): n = A,T,C or G
gtgctgggattanaggtgtgaaccac

SEQ ID NO: 82 - DNA, 29 bp, Homo sapiens
  misc_feature (1)...(29): n = A,T,C or G
aggtgtgaaccactgntcccagccacttc

SEQ ID NO: 83 - DNA, 26 bp, Homo sapiens
  misc_feature (1)...(26): n = A,T,C or G
ttcatttatgcacatnacacacacac

SEQ ID NO: 84 - DNA, 27 bp, Homo sapiens
  misc_feature (1)...(27): n = A,T,C or G
ttccatccactgtgnacagtgttattt

SEQ ID NO: 85 - DNA, 28 bp, Homo sapiens
  misc_feature (1)...(28): n = A,T,C or G
ggaattctgcaaaanaaacatttcatta

SEQ ID NO: 86 - DNA, 26 bp, Homo sapiens
  misc_feature (1)...(26): n = A,T,C or G
ggtaagcatttgtcntgcctgcctgt

SEQ ID NO: 87 - DNA, 36 bp, Homo sapiens
  misc_feature (1)...(36): n = A,T,C or G
accattacctatctgctttnggggtgggtggcgcgg

SEQ ID NO: 88 - DNA, 37 bp, Homo sapiens
  misc_feature (1)...(37): n = A,T,C or G
tccctccttgagtgtcctcancggcttcctggggtac

SEQ ID NO: 89 - DNA, 28 bp, Homo sapiens
  misc_feature (1)...(28): n = A,T,C or G
cacgccaccatcntctctagcctggttt

SEQ ID NO: 90 - DNA, 22 bp, Homo sapiens
  misc_feature (1)...(22): n = A,T,C or G
atcttgcttcnatgctttcccc

SEQ ID NO: 91 - DNA, 20 bp, Homo sapiens
  misc_feature (1)...(20): n = A,T,C or G
ccctacaaccnatctgtcag

SEQ ID NO: 92 - DNA, 33 bp, Homo sapiens
  misc_feature (1)...(33): n = A,T,C or G
aagggtgctgcagctccnaaggagtgtttagaa

SEQ ID NO: 93 - DNA, 31 bp, Homo sapiens
  misc_feature (1)...(31): n = A,T,C or G
gagcagcacatggnccaagtgaggagctaag

SEQ ID NO: 94 - DNA, 36 bp, Homo sapiens
  misc_feature (1)...(36): n = A,T,C or G
tcccaccagccagaggtaactantgctgttaatatt

SEQ ID NO: 95 - DNA, 33 bp, Homo sapiens
  misc_feature (1)...(33): n = A,T,C or G
ggtggtattagagaacangggattgagagctgc

SEQ ID NO: 96 - DNA, 22 bp, Homo sapiens
  misc_feature (1)...(22): n = A,T,C or G
gcagatttttgnttctgtaaat

SEQ ID NO: 97 - DNA, 26 bp, Homo sapiens
  misc_feature (1)...(26): n = A,T,C or G
agttcatattttaangttttttcagg

SEQ ID NO: 98 - DNA, 25 bp, Homo sapiens
  misc_feature (1)...(25): n = A,T,C or G
cttctttactctntacatataccat

SEQ ID NO: 99 - DNA, 40 bp, Homo sapiens
  misc_feature (1)...(40): n = A,T,C or G
aaccctctaaagatatttttnaaaggactttctaaaggaa

SEQ ID NO: 100 - DNA, 38 bp, Homo sapiens
  misc_feature (1)...(38): n = A,T,C or G
gtgcaaggccttaacgttttanttgctctggtatcgca

SEQ ID NO: 101 - DNA, 31 bp, Homo sapiens
  misc_feature (1)...(31): n = A,T,C or G
tctagctctggctgntgagtgtgtctgccag

SEQ ID NO: 102 - DNA, 34 bp, Homo sapiens
  misc_feature (1)...(34): n = A,T,C or G
tttggtaaataggaaatngctccaactacttgtc

SEQ ID NO: 103 - DNA, 20 bp, Homo sapiens
  misc_feature (1)...(20): n = A,T,C or G
ggagattttatanacacaca

SEQ ID NO: 104 - DNA, 16 bp, Homo sapiens
  misc_feature (1)...(16): n = A,T,C or G
ccctatctcanaaaaa

SEQ ID NO: 105 - DNA, 35 bp, Homo sapiens
  misc_feature (1)...(35): n = A,T,C or G
atgaaatgagatagtccagctaaangcccgaagag

SEQ ID NO: 106 - DNA, 19 bp, Homo sapiens
  misc_feature (1)...(19): n = A,T,C or G
agagcaagctnaggagctc

SEQ ID NO: 107 - DNA, 25 bp, Homo sapiens
  misc_feature (1)...(25): n = A,T,C or G
gctctggacggcnagccccggaacc

SEQ ID NO: 108 - DNA, 21 bp, Homo sapiens
  misc_feature (1)...(21): n = A,T,C or G
acaatgtgagncaattagttt

SEQ ID NO: 109 - DNA, 19 bp, Homo sapiens
  misc_feature (1)...(19): n = A,T,C or G
agcactggggnacaatgtt

SEQ ID NO: 110 - DNA, 20 bp, Homo sapiens
  misc_feature (1)...(20): n = A,T,C or G
tcaggaatgacntttttttt

SEQ ID NO: 111 - DNA, 20 bp, Homo sapiens
  misc_feature (1)...(20): n = A,T,C or G
aagagctacngtcttaccaa

SEQ ID NO: 112 - DNA, 18 bp, Homo sapiens
  misc_feature (1)...(18): n = A,T,C or G
cctcacccnagcagtgaa

SEQ ID NO: 113 - DNA, 17 bp, Homo sapiens
  misc_feature (1)...(17): n = A,T,C or G
tatgaatttcntttttt

SEQ ID NO: 114 - DNA, 21 bp, Homo sapiens
  misc_feature (1)...(21): n = A,T,C or G
tgcaatggcncagtctcagct

SEQ ID NO: 115 - DNA, 22 bp, Homo sapiens
  misc_feature (1)...(22): n = A,T,C or G
ccttgggcacnctactcagcct

SEQ ID NO: 116 - DNA, 21 bp, Homo sapiens
  misc_feature (1)...(21): n = A,T,C or G
ctggccagangggccctcccc

SEQ ID NO: 117 - DNA, 20 bp, Homo sapiens
  misc_feature (1)...(20): n = A,T,C or G
aggatttcangcaggaaagt

SEQ ID NO: 118 - DNA, 23 bp, Homo sapiens
  misc_feature (1)...(23): n = A,T,C or G
agcttgtcagncttcatctaatt

SEQ ID NO: 119 - DNA, 22 bp, Homo sapiens
  misc_feature (1)...(22): n = A,T,C or G
ggatctcgcacnggaaggaatt

SEQ ID NO: 120 - DNA, 22 bp, Homo sapiens
  misc_feature (1)...(22): n = A,T,C or G
gtactttgttnatttaaataat

SEQ ID NO: 121 - DNA, 19 bp, Homo sapiens
  misc_feature (1)...(19): n = A,T,C or G
ttgacaaaantggccatga

SEQ ID NO: 122 - DNA, 21 bp, Homo sapiens
  misc_feature (1)...(21): n = A,T,C or G
tagaagatttnaaaattgtaa

SEQ ID NO: 123 - DNA, 27 bp, Homo sapiens
  misc_feature (1)...(27): n = A,T,C or G
cacacgctcanatccaagccaccccaa

SEQ ID NO: 124 - DNA, 21 bp, Homo sapiens
  misc_feature (1)...(21): n = A,T,C or G
gtgcatggntgtcccctcccc

SEQ ID NO: 125 - DNA, 19 bp, Homo sapiens
  misc_feature (1)...(19): n = A,T,C or G
tctctgttcncatcttatc

SEQ ID NO: 126 - DNA, 17 bp, Homo sapiens
  misc_feature (1)...(17): n = A,T,C or G
tccatactngttgaatg

SEQ ID NO: 127 - DNA, 18 bp, Homo sapiens
  misc_feature (1)...(18): n = A,T,C or G
agagcacanacacatgga

SEQ ID NO: 128 - DNA, 30 bp, Homo sapiens
  misc_feature (1)...(30): n = A,T,C or G
ctagatgaagggcatangcagaagacattt

SEQ ID NO: 129 - DNA, 28 bp, Homo sapiens
  misc_feature (1)...(28): n = A,T,C or G
gggctggggttcccgnggtgccaagggg

SEQ ID NO: 130 - DNA, 32 bp, Homo sapiens
  misc_feature (1)...(32): n = A,T,C or G
cctccgtaaatatccttncagccttaaaccct

SEQ ID NO: 131 - DNA, 23 bp, Homo sapiens
  misc_feature (1)...(23): n = A,T,C or G
atttaaatacnaggaaaaacaat

SEQ ID NO: 132 - DNA, 34 bp, Homo sapiens
  misc_feature (1)...(34): n = A,T,C or G
tattaccagggactcctggngtccactgctttag

SEQ ID NO: 133 - DNA, 36 bp, Homo sapiens
  misc_feature (1)...(36): n = A,T,C or G
aacccttggctccaagtgcnagcagccacagtcttc

SEQ ID NO: 134 - DNA, 33 bp, Homo sapiens
  misc_feature (1)...(33): n = A,T,C or G
ttcgaagtttcagttgaacngtccctcgcgaaa

SEQ ID NO: 135 - DNA, 30 bp, Homo sapiens
  misc_feature (1)...(30): n = A,T,C or G
gacaaagaggtcagcacntgagtagaacgc

SEQ ID NO: 136 - DNA, 36 bp, Homo sapiens
  misc_feature (1)...(36): n = A,T,C or G
aaggagcggactctactaangaatcctcctgtaagg

SEQ ID NO: 137 - DNA, 35 bp, Homo sapiens
  misc_feature (1)...(35): n = A,T,C or G
tgtaagggcgggcctatnatggtgctggggagaat

SEQ ID NO: 138 - DNA, 34 bp, Homo sapiens
  misc_feature (1)...(34): n = A,T,C or G
tcctgctcttccctcnttttcctagaagtcctcc

SEQ ID NO: 139 - DNA, 34 bp, Homo sapiens
  misc_feature (1)...(34): n = A,T,C or G
tggccgtgtgaccccnctacgggcctgtttccta

SEQ ID NO: 140 - DNA, 35 bp, Homo sapiens
  misc_feature (1)...(35): n = A,T,C or G
taccaaagggccgctccnggcacttggcgcatgtg

SEQ ID NO: 141 - DNA, 27 bp, Homo sapiens
  misc_feature (1)...(27): n = A,T,C or G
ttcttaggtgttgnttttttttttttt

SEQ ID NO: 142 - DNA, 37 bp, Homo sapiens
  misc_feature (1)...(37): n = A,T,C or G
ttccattgttttcanttggaatttatatttttaatgt

SEQ ID NO: 143 - DNA, 37 bp, Homo sapiens; identical to SEQ ID NO: 142
  misc_feature (1)...(37): n = A,T,C or G

SEQ ID NO: 144 - DNA, 20 bp, Homo sapiens
  misc_feature (1)...(20): n = A,T,C or G
tctaactgtntcttaaactg

SEQ ID NO: 145 - DNA, 36 bp, Homo sapiens
  misc_feature (1)...(36): n = A,T,C or G
ttattccattgttttcanttggaatttatattttta

SEQ ID NO: 146 - DNA, 37 bp, Homo sapiens
  misc_feature (1)...(37): n = A,T,C or G
ctgacatattttatttanttattagtattttttttga

SEQ ID NO: 147 - DNA, 25 bp, Homo sapiens
  misc_feature (1)...(25): n = A,T,C or G
aagcagagccanacatacatctcac

SEQ ID NO: 148 - DNA, 24 bp, Homo sapiens
  misc_feature (1)...(24): n = A,T,C or G
agaaagggactntctggagccagg

SEQ ID NO: 149 - DNA, 29 bp, Homo sapiens
  misc_feature (1)...(29): n = A,T,C or G
tttttctctgccancatagtccttatgca

SEQ ID NO: 150 - DNA, 24 bp, Homo sapiens
  misc_feature (1)...(24): n = A,T,C or G
gcaagccagangacagggccacag

SEQ ID NO: 151 - DNA, 26 bp, Homo sapiens
  misc_feature (1)...(26): n = A,T,C or G
cctgtctttgaatncaaactgctgtc

SEQ ID NO: 152 - DNA, 19 bp, Homo sapiens
  misc_feature (1)...(19): n = A,T,C or G
atgcatggcatgttcnttt

SEQ ID NO: 153 - DNA, 18 bp, Homo sapiens
  misc_feature (1)...(18): n = A,T,C or G
tagagacngagtttcacc

SEQ ID NO: 154 - DNA, 18 bp, Homo sapiens
  misc_feature (1)...(18): n = A,T,C or G
ctggagtncaatggcacg

SEQ ID NO: 155 - DNA, 36 bp, Homo sapiens
  misc_feature (1)...(36): n = A,T,C or G
atgaaaactctaacggntcttcagcttcttgttcta

SEQ ID NO: 156 - DNA, 31 bp, Homo sapiens
  misc_feature (1)...(31): n = A,T,C or G
tgattttagaattttattnaaaaaaagtcaa

SEQ ID NO: 157 - DNA, 22 bp, Homo sapiens
  misc_feature (1)...(22): n = A,T,C or G
tttttcttatngcattttggct

SEQ ID NO: 158 - DNA, 25 bp, Homo sapiens
  misc_feature (1)...(25): n = A,T,C or G
aattagccaggngtgggagcgcgca

SEQ ID NO: 159 - DNA, 29 bp, Homo sapiens
  misc_feature (1)...(29): n = A,T,C or G
ctgacattaccagnggaaaacaatggctg

SEQ ID NO: 160 - DNA, 19 bp, Homo sapiens
  misc_feature (1)...(19): n = A,T,C or G
cgagactccatctggnaaa

SEQ ID NO: 161 - DNA, 17 bp, Homo sapiens
  misc_feature (1)...(17): n = A,T,C or G
aaangagtttcctctgg

SEQ ID NO: 162 - DNA, 29 bp, Homo sapiens
  misc_feature (1)...(29): n = A,T,C or G
cagcttcttatgttgnttttattcctcag

SEQ ID NO: 163 - DNA, 33 bp, Homo sapiens
  misc_feature (1)...(33): n = A,T,C or G
ttaggttctttggaagcnggtttatgaactaat

SEQ ID NO: 164 - DNA, 26 bp, Homo sapiens
  misc_feature (1)...(26): n = A,T,C or G
aagattcaatgnaatcagtgacttgt

SEQ ID NO: 165 - DNA, 24 bp, Homo sapiens
  misc_feature (1)...(24): n = A,T,C or G
ggtagatgtgntattacaaagatg

SEQ ID NO: 166 - DNA, 17 bp, Homo sapiens
  misc_feature (1)...(17): n = A,T,C or G
aaaaaanttattacccg

SEQ ID NO: 167 - DNA, 21 bp, Homo sapiens
  misc_feature (1)...(21): n = A,T,C or G
gagctagactctgtctcnaaa

SEQ ID NO: 168 - DNA, 19 bp, Homo sapiens
  misc_feature (1)...(19): n = A,T,C or G
tctactaaanatacaaaaa

SEQ ID NO: 169 - DNA, 15 bp, Homo sapiens
  misc_feature (1)...(15): n = A,T,C or G
atacaanaattagcc

SEQ ID NO: 170 - DNA, 25 bp, Homo sapiens
  misc_feature (1)...(25): n = A,T,C or G
aaatacaaataganaacatacaaaa

SEQ ID NO: 171 - DNA, 19 bp, Homo sapiens
  misc_feature (1)...(19): n = A,T,C or G
taccttgangtgtgttctg

SEQ ID NO: 172 - DNA, 26 bp, Homo sapiens
  misc_feature (1)...(26): n = A,T,C or G
gtggctcacacntgcaatcccagcac

SEQ ID NO: 173 - DNA, 23 bp, Homo sapiens
  misc_feature (1)...(23): n = A,T,C or G
cccaggaagtcnaggctgcagtg

SEQ ID NO: 174 - DNA, 23 bp, Homo sapiens
  misc_feature (1)...(23): n = A,T,C or G
gagccagactctgtcttnaaaaa

SEQ ID NO: 175 - DNA, 30 bp, Homo sapiens
  misc_feature (1)...(30): n = A,T,C or G
ctctatctctactaaanatacaaaaattag

SEQ ID NO: 176 - DNA, 29 bp, Homo sapiens
  misc_feature (1)...(29): n = A,T,C or G
atacaaaaattagcnggtgtggtggtggg

SEQ ID NO: 177 - DNA, 29 bp, Homo sapiens
  misc_feature (1)...(29): n = A,T,C or G
gaatgaactccagcntgggtgacagagcc

SEQ ID NO: 178 - DNA, 30 bp, Homo sapiens
  misc_feature (1)...(30): n = A,T,C or G
gactctaaggtgagcnctgaataaagccct

SEQ ID NO: 179 - DNA, 37 bp, Homo sapiens
  misc_feature (1)...(37): n = A,T,C or G
gtatattgtattagtatngggtaatacattccaaatg

SEQ ID NO: 180 - DNA, 33 bp, Homo sapiens
  misc_feature (1)...(33): n = A,T,C or G
ggcaaaaagagcgaaactctgtctcaaaaaaan

SEQ ID NO: 181 - DNA, 39 bp, Homo sapiens
  misc_feature (1)...(39): n = A,T,C or G
agcctggctttgttccttaanaagcctaaattgctagaa

SEQ ID NO: 182 - DNA, 33 bp, Homo sapiens
  misc_feature (1)...(33): n = A,T,C or G
ccaagctccctcatagntcctcattctgctcag

SEQ ID NO: 183 - DNA, 33 bp, Homo sapiens
  misc_feature (1)...(33): n = A,T,C or G
tttttctttttttttnctgagacagtttttttc

SEQ ID NO: 184 - DNA, 20 bp, Homo sapiens
  misc_feature (1)...(20): n = A,T,C or G
agagactccgtctcnaaaaa

SEQ ID NO: 185 - DNA, 35 bp, Homo sapiens
  misc_feature (1)...(35): n = A,T,C or G
ttttctgcagtaatacntattaaaaatttagattc

SEQ ID NO: 186 - DNA, 33 bp, Homo sapiens
  misc_feature (1)...(33): n = A,T,C or G
cagaaccctcatagcatgngatcactgataaag

SEQ ID NO: 187 - DNA, 31 bp, Homo sapiens
  misc_feature (1)...(31): n = A,T,C or G
catcaacaaggttcttanagaattcctaagg

SEQ ID NO: 188 - DNA, 29 bp, Homo sapiens
  misc_feature (1)...(29): n = A,T,C or G
aaatgagaaaatctanaatgaatctctgt

SEQ ID NO: 189 - DNA, 29 bp, Homo sapiens
  misc_feature (1)...(29): n = A,T,C or G
tatcacttcttcagtnataaagttcttaa

SEQ ID NO: 190 - DNA, 40 bp, Homo sapiens
  misc_feature (1)...(40): n = A,T,C or G
aacaggtatttaatattcttcacattncagtaataaagac

SEQ ID NO: 191 - DNA, 15 bp, Homo sapiens
  misc_feature (1)...(15): n = A,T,C or G
ttttagagntttttt

SEQ ID NO: 192 - DNA, 18 bp, Homo sapiens
  misc_feature (1)...(18): n = A,T,C or G
aagtgctggnatatacac

SEQ ID NO: 193 - DNA, 31 bp, Homo sapiens
  misc_feature (1)...(31): n = A,T,C or G
cagtcctatatttcaaangagcaaacagaca

SEQ ID NO: 194 - DNA, 31 bp, Homo sapiens
  misc_feature (1)...(31): n = A,T,C or G
aaactattttactaaanagaagtccccatta

SEQ ID NO: 195 - DNA, 24 bp, Homo sapiens
  misc_feature (1)...(24): n = A,T,C or G
aaactctatcttnaaaaaaaaaaa

SEQ ID NO: 196 - DNA, 20 bp, Homo sapiens
  misc_feature (1)...(20): n = A,T,C or G
tgttgtgcanagtaagagaa

SEQ ID NO: 197 - DNA, 21 bp, Homo sapiens
  misc_feature (1)...(21): n = A,T,C or G
cctaacattanttcaaaataa

SEQ ID NO: 198 - DNA, 18 bp, Homo sapiens
  misc_feature (1)...(18): n = A,T,C or G
agttttttnaaatttttt

SEQ ID NO: 199 - DNA, 19 bp, Homo sapiens
  misc_feature (1)...(19): n = A,T,C or G
aaaaattanaaaaattagc

SEQ ID NO: 200 - DNA, 19 bp, Homo sapiens
  misc_feature (1)...(19): n = A,T,C or G
aggctgaggnatgggaatc

SEQ ID NO: 201 - DNA, 19 bp, Homo sapiens
  misc_feature (1)...(19): n = A,T,C or G
aacaagcttntctttaaac

SEQ ID NO: 202 - DNA, 20 bp, Homo sapiens
  misc_feature (1)...(20): n = A,T,C or G
ttttttttnagctctgattc

SEQ ID NO: 203 - DNA, 19 bp, Homo sapiens
  misc_feature (1)...(19): n = A,T,C or G
atgctagcnatgtaaaaaa

SEQ ID NO: 204 - DNA, 18 bp, Homo sapiens
  misc_feature (1)...(18): n = A,T,C or G
aaaaaaacanaaggcact

SEQ ID NO: 205 - DNA, 19 bp, Homo sapiens
  misc_feature (1)...(19): n = A,T,C or G
gaagggtcanacaggaaag

SEQ ID NO: 206 - DNA, 20 bp, Homo sapiens
  misc_feature (1)...(20): n = A,T,C or G
ggagcaaaaanaaatgttta

SEQ ID NO: 207 - DNA, 20 bp, Homo sapiens
  misc_feature (1)...(20): n = A,T,C or G
atatattccnagaaatgcat

SEQ ID NO: 208 - DNA, 21 bp, Homo sapiens
  misc_feature (1)...(21): n = A,T,C or G
aaatgcatcantaggcaattt

SEQ ID NO: 209 - DNA, 21 bp, Homo sapiens
  misc_feature (1)...(21): n = A,T,C or G
gacgaccttttnaaaaaaaaa

SEQ ID NO: 210 - DNA, 22 bp, Homo sapiens
  misc_feature (1)...(22): n = A,T,C or G
ttttaataacntgtaaaatgcc

SEQ ID NO: 211 - DNA, 17 bp, Homo sapiens
  misc_feature (1)...(17): n = A,T,C or G
gctgctggntgagaggt

SEQ ID NO: 212 - DNA, 18 bp, Homo sapiens
  misc_feature (1)...(18): n = A,T,C or G
gctttttaaantttttct

SEQ ID NO: 213 - DNA, 20 bp, Homo sapiens
  misc_feature (1)...(20): n = A,T,C or G
ctacaaagtntatttaaggg

SEQ ID NO: 214 - DNA, 22 bp, Homo sapiens
  misc_feature (1)...(22): n = A,T,C or G
ttttgcttcanagcctttcctt

SEQ ID NO: 215 - DNA, 22 bp, Homo sapiens
  misc_feature (1)...(22): n = A,T,C or G
taaactatatatangtgtgtgt

SEQ ID NO: 216 - DNA, 20 bp, Homo sapiens
  misc_feature (1)...(20): n = A,T,C or G
tctgggagtantggcacaca

SEQ ID NO: 217 - DNA, 37 bp, Homo sapiens
  misc_feature (1)...(37): n = A,T,C or G
accagtaattatttaaaaatnaaagtactaattgttt

SEQ ID NO: 218 - DNA, 36 bp, Homo sapiens
  misc_feature (1)...(36): n = A,T,C or G
agccgggcgtggtggcagntgcctgtaatcccagct

SEQ ID NO: 219 - DNA, 21 bp, Homo sapiens
  misc_feature (1)...(21): n = A,T,C or G
gttttgaganagtctcactct

SEQ ID NO: 220 - DNA, 32 bp, Homo sapiens
  misc_feature (1)...(32): n = A,T,C or G
taattttaaaggctctgntccctgctcttttc

SEQ ID NO: 221 - DNA, 20 bp, Homo sapiens
  misc_feature (1)...(20): n = A,T,C or G
acttccttcnctccccaggg

SEQ ID NO: 222 - DNA, 20 bp, Homo sapiens
  misc_feature (1)...(20): n = A,T,C or G
ctccaaggganctctgctcc

SEQ ID NO: 223 - DNA, 17 bp, Homo sapiens
  misc_feature (1)...(17): n = A,T,C or G
tggatgganggacgaac

SEQ ID NO: 224 - DNA, 18 bp, Homo sapiens
  misc_feature (1)...(18): n = A,T,C or G
taggggaggncattccag

SEQ ID NO: 225 - DNA, 20 bp, Homo sapiens
  misc_feature (1)...(20): n = A,T,C or G
caaggggaagngcattccag

SEQ ID NO: 226 - DNA, 18 bp, Homo sapiens
  misc_feature (1)...(18): n = A,T,C or G
gcagtgggncaagtgtgg

SEQ ID NO: 227 - DNA, 18 bp, Homo sapiens
  misc_feature (1)...(18): n = A,T,C or G
gtttgttngttttttgag

SEQ ID NO: 228 - DNA, 20 bp, Homo sapiens
  misc_feature (1)...(20): n = A,T,C or G
actgggatgntcctaaactg

SEQ ID NO: 229 - DNA, 18 bp, Homo sapiens
  misc_feature (1)...(18): n = A,T,C or G
gactttttnaatagagat

SEQ ID NO: 230 - DNA, 20 bp, Homo sapiens
  misc_feature (1)...(20): n = A,T,C or G
caagacagtgnataaatagc

SEQ ID NO: 231 - DNA, 18 bp, Homo sapiens
  misc_feature (1)...(18): n = A,T,C or G
aaagaaaantcagaattt

SEQ ID NO: 232 - DNA, 20 bp, Homo sapiens
  misc_feature (1)...(20): n = A,T,C or G
cctccttccccncttctctc

SEQ ID NO: 233 - DNA, 20 bp, Homo sapiens
  misc_feature (1)...(20): n = A,T,C or G
tcaaaagagancaatgatga

SEQ ID NO: 234 - DNA, 19 bp, Homo sapiens
  misc_feature (1)...(19): n = A,T,C or G
aaagtactantatgaaaat

SEQ ID NO: 235 - DNA, 19 bp, Homo sapiens
  misc_feature (1)...(19): n = A,T,C or G
tatatatanacacacatac

SEQ ID NO: 236 - DNA, 17 bp, Homo sapiens
  misc_feature (1)...(17): n = A,T,C or G
gaagaaanagtgcagtg

SEQ ID NO: 237 - DNA, 20 bp, Homo sapiens
  misc_feature (1)...(20): n = A,T,C or G
aaaatatgcntcaggagtga

SEQ ID NO: 238 - DNA, 19 bp, Homo sapiens
  misc_feature (1)...(19): n = A,T,C or G
aaaaaaagnccaacagaaa

SEQ ID NO: 239 - DNA, 19 bp, Homo sapiens
  misc_feature (1)...(19): n = A,T,C or G
tttttttttnagggagagt

SEQ ID NO: 240 - DNA, 21 bp, Homo sapiens
  misc_feature (1)...(21): n = A,T,C or G
ttctgttgctcnggctggagt

SEQ ID NO: 241 - DNA, 19 bp, Homo sapiens
  misc_feature (1)...(19): n = A,T,C or G
aacttagaantctcccagg

SEQ ID NO: 242 - DNA, 19 bp, Homo sapiens
  misc_feature (1)...(19): n = A,T,C or G
aggaattgaanttaataga

SEQ ID NO: 243 - DNA, 17 bp, Homo sapiens
  misc_feature (1)...(17): n = A,T,C or G
cacttgtgntgattaat

SEQ ID NO: 244 - DNA, 19 bp, Homo sapiens
  misc_feature (1)...(19): n = A,T,C or G
gcaagaagcncaacaaacc

SEQ ID NO: 245 - DNA, 17 bp, Homo sapiens
  misc_feature (1)...(17): n = A,T,C or G
agtctccaacntttttt

SEQ ID NO: 246 - DNA, 21 bp, Homo sapiens
  misc_feature (1)...(21): n = A,T,C or G
ttaatatgatnaaatgctcaa

SEQ ID NO: 247 - DNA, 23 bp, Homo sapiens
  misc_feature (1)...(23): n = A,T,C or G
cccccacaaagnccgagaagcct

SEQ ID NO: 248 - DNA, 34 bp, Homo sapiens
  misc_feature (1)...(34): n = A,T,C or G
aaaatcgagatgaaggntttgagcatttcagaga

SEQ ID NO: 249 - DNA, 26 bp, Homo sapiens
  misc_feature (1)...(26): n = A,T,C or G
ttgcagtgagccnagatcacgtcact

SEQ ID NO: 250 - DNA, 29 bp, Homo sapiens
  misc_feature (1)...(29): n = A,T,C or G
tagagtttgttcccnagagtttgttccca

SEQ ID NO: 251 - DNA, 26 bp, Homo sapiens
  misc_feature (1)...(26): n = A,T,C or G
ctttagtttcatcttncctactgcca

SEQ ID NO: 252 - DNA, 19 bp, Homo sapiens
  misc_feature (1)...(19): n = A,T,C or G
ctggctccnaattaataag

SEQ ID NO: 253 - DNA, 37 bp, Homo sapiens
  misc_feature (1)...(37): n = A,T,C or G
taaagtaagaatccctaaggttnaaaaaaaaaaaaag

SEQ ID NO: 254 - DNA, 40 bp, Homo sapiens
  misc_feature (1)...(40): n = A,T,C or G
ttacttctgcaggagctntagggagatgaaggaagaagcc

SEQ ID NO: 255 - DNA, 35 bp, Homo sapiens
  misc_feature (1)...(35): n = A,T,C or G
ccctggagggagagctgnggtgaaggaaatgacac

SEQ ID NO: 256 - DNA, 32 bp, Homo sapiens
  misc_feature (1)...(32): n = A,T,C or G
agagttaagtaggggnccttaccaaggagcat

SEQ ID NO: 257 - DNA, 27 bp, Homo sapiens
  misc_feature (1)...(27): n = A,T,C or G
aggctttctgcctncttcacttcccca

SEQ ID NO: 258 - DNA, 26 bp, Homo sapiens
  misc_feature (1)...(26): n = A,T,C or G
ggtagggctactnttattttatggtt

SEQ ID NO: 259 - DNA, 29 bp, Homo sapiens
  misc_feature (1)...(29): n = A,T,C or G
cctggtcactattanaccctgcaacggcg

SEQ ID NO: 260 - DNA, 29 bp, Homo sapiens
  misc_feature (1)...(29): n = A,T,C or G
agcacacggggcanggtaggctttctgcc

SEQ ID NO: 261 - DNA, 26 bp, Homo sapiens
  misc_feature (1)...(26): n = A,T,C or G
gggcgatcacctcncctgcgttcggg

SEQ ID NO: 262 - DNA, 26 bp, Homo sapiens
  misc_feature (1)...(26): n = A,T,C or G
acaggctggggccnggggcgctgggc

SEQ ID NO: 263 - DNA, 49 bp, Homo sapiens
  misc_feature (1)...(49): n = A,T,C or G
agacgtgcgcccgagccccgccgaancgaggccacccggagccgtgccc

SEQ ID NO: 264 - DNA, 40 bp, Homo sapiens
  misc_feature (1)...(40): n = A,T,C or G
ccactcggagtcgcgctncgcgcgccctcactgcagcccc

SEQ ID NO: 265 - DNA, 28 bp, Homo sapiens
  misc_feature (1)...(28): n = A,T,C or G
aaaggatttgaattttgagngaaaagtt

SEQ ID NO: 266 - DNA, 37 bp, Homo sapiens
  misc_feature (1)...(37): n = A,T,C or G
ctcgcagtagtcctgtgggntagatcttactaatgtc

SEQ ID NO: 267 - DNA, 32 bp, Homo sapiens
  misc_feature (1)...(32): n = A,T,C or G
ggaagaagttcttacttccntgtgggtgctta

SEQ ID NO: 268 - DNA, 24 bp, Homo sapiens
  misc_feature (1)...(24): n = A,T,C or G
acttcatatttntcactgtgtccc

SEQ ID NO: 269 - DNA, 38 bp, Homo sapiens
  misc_feature (1)...(38): n = A,T,C or G
ggtccctgagctcccngagacaacatgcagaattactg

SEQ ID NO: 270 - DNA, 34 bp, Homo sapiens
  misc_feature (1)...(34): n = A,T,C or G
gtcagcccacccattnagtaactgttctctgctg

SEQ ID NO: 271 - DNA, 35 bp, Homo sapiens
  misc_feature (1)...(35): n = A,T,C or G
gagagagaaaagatgntcagaactccacctggcac

SEQ ID NO: 272 - DNA, 24 bp, Homo sapiens
  misc_feature (1)...(24): n = A,T,C or G
tctccccgactngcacatcccagt

SEQ ID NO: 273 - DNA, 40 bp, Homo sapiens
  misc_feature (1)...(40): n = A,T,C or G
ccccagcactgtcgccntgtgctgtcagcagcactctccc

SEQ ID NO: 274 - DNA, 35 bp, Homo sapiens
  misc_feature (1)...(35): n = A,T,C or G
acctgtggcttctgctgtnccccagcactgtcgcc

SEQ ID NO: 275 - DNA, 40 bp, Homo sapiens
  misc_feature (1)...(40): n = A,T,C or G
gcagggttggtcggngggcgctcgatgtcttgcaaactaa

SEQ ID NO: 276 - DNA, 40 bp, Homo sapiens
  misc_feature (1)...(40): n = A,T,C or G
caggtctggcaggngaccccacaggtcagtgggatgactc

SEQ ID NO: 277 - DNA, 28 bp, Homo sapiens
  misc_feature (1)...(28): n = A,T,C or G
actccaggtgagctgntccaggtctggc

SEQ ID NO: 278 - DNA, 39 bp, Homo sapiens
  misc_feature (1)...(39): n = A,T,C or G
ggccaggggtgcattttgnggtgctggttctccttcctc

SEQ ID NO: 279 - DNA, 39 bp, Homo sapiens
  misc_feature (1)...(39): n = A,T,C or G
ccatagggggaggcaagcgacngggacactaggaaggca

SEQ ID NO: 280 - DNA, 37 bp, Homo sapiens
  misc_feature (1)...(37): n = A,T,C or G
ctgcagtacagtgggggctgntgagaggagggaaggg

SEQ ID NO: 281 - DNA, 33 bp, Homo sapiens
  misc_feature (1)...(33): n = A,T,C or G
gtgtgncagagagacagagagacagagagagag

SEQ ID NO: 282 - DNA, 35 bp, Homo sapiens
  misc_feature (1)...(35): n = A,T,C or G
gcccagcatctgagggntaggggtgtaatacggca

SEQ ID NO: 283 - DNA, 40 bp, Homo sapiens
  misc_feature (1)...(40): n = A,T,C or G
aggtcaggagttngagaccagcctgactaacatggtgaaa

SEQ ID NO: 284 - DNA, 38 bp, Homo sapiens
  misc_feature (1)...(38): n = A,T,C or G
aatcagcctttaggatcngttaatatgatgatggcttt

SEQ ID NO: 285 - DNA, 38 bp, Homo sapiens
  misc_feature (1)...(38): n = A,T,C or G
ctgttgtcacctggctgnttgcattgtcccacaagtgc

SEQ ID NO: 286 - DNA, 29 bp, Homo sapiens
  misc_feature (1)...(29): n = A,T,C or G
ggaaagccaccatnggaagggaaggcagg

SEQ ID NO: 287 - DNA, 37 bp, Homo sapiens
  misc_feature (1)...(37): n = A,T,C or G
gccaagggtgtgatactggctnagaggagctggctca

SEQ ID NO: 288 - DNA, 35 bp, Homo sapiens
  misc_feature (1)...(35): n = A,T,C or G
atggagaaagcttgggggcaggnccagggagcagg

SEQ ID NO: 289 - DNA, 37 bp, Homo sapiens
  misc_feature (1)...(37): n = A,T,C or G
cacattgtgaattagctacngctgccatgccttaagg

SEQ ID NO: 290 - DNA, 28 bp, Homo sapiens
  misc_feature (1)...(28): n = A,T,C or G
gggcagggccagggngcagggcggtaaa

SEQ ID NO: 291 - DNA, 32 bp, Homo sapiens
  misc_feature (1)...(32): n = A,T,C or G
cctgatgccaccgtcccntaccctcatacaac

SEQ ID NO: 292 - DNA, 37 bp, Homo sapiens
  misc_feature (1)...(37): n = A,T,C or G
ctgatgccaccgtcccctnccctcatacaaccttctt

SEQ ID NO: 293 - DNA, 27 bp, Homo sapiens
  misc_feature (1)...(27): n = A,T,C or G
ttgccctccatccangccattccctgt

SEQ ID NO: 294 - DNA, 27 bp, Homo sapiens
  misc_feature (1)...(27): n = A,T,C or G
aagctggacttctgtnggcccctcaac

SEQ ID NO: 295 - DNA, 32 bp, Homo sapiens
  misc_feature (1)...(32): n = A,T,C or G
cacaaagaactaccccnttttcagctgagccc

SEQ ID NO: 296 - DNA, 34 bp, Homo sapiens
  misc_feature (1)...(34): n = A,T,C or G
gtggggtccttcggggcnatgctccctcagcctc

SEQ ID NO: 297 - DNA, 36 bp, Homo sapiens
  misc_feature (1)...(36): n = A,T,C or G
tcatgtgtgaacacatangacgtgtgtaaatatgta

SEQ ID NO: 298 - DNA, 39 bp, Homo sapiens
  misc_feature (1)...(39): n = A,T,C or G
aaagtaaattgtttataangggtgtggcctttttagaga

SEQ ID NO: 299 - DNA, 35 bp, Homo sapiens
  misc_feature (1)...(35): n = A,T,C or G
gaacagggacatgcatctnttataaaatcctttcg

SEQ ID NO: 300 - DNA, 40 bp, Homo sapiens
  misc_feature (1)...(40): n = A,T,C or G
ttataaaatcctttcggncaggcgcggtggctcacacctg

SEQ ID NO: 301 - DNA, 38 bp, Homo sapiens
  misc_feature (1)...(38): n = A,T,C or G
tcacctgaggtcaggagttngagaccagcctggtgaaa

SEQ ID NO: 302 - DNA, 24 bp, Homo sapiens
  misc_feature (1)...(24): n = A,T,C or G
actccagcccgggcaccnaaaaaa

SEQ ID NO: 303 - DNA, 31 bp, Homo sapiens
  misc_feature (1)...(31): n = A,T,C or G
tgaacccgggagatgnaggttgcagtgagct

SEQ ID NO: 304 - DNA, 37 bp, Homo sapiens
  misc_feature (1)...(37): n = A,T,C or G
tccagcctgggtgacaagagngagactttgtctcaaa

SEQ ID NO: 305 - DNA, 28 bp, Homo sapiens
ttgtctcaaaaaaaaaaaaatccttttg

SEQ ID NO: 306 - DNA, 33 bp, Homo sapiens
  misc_feature (1)...(33): n = A,T,C or G
gaaggtgtggatatgtgcntttcctgtctccct

SEQ ID NO: 307 - DNA, 37 bp, Homo sapiens
  misc_feature (1)...(37): n = A,T,C or G
gatgctgtgtgagtggcaggnggactcctgctgggta

SEQ ID NO: 308 - DNA, 28 bp, Homo sapiens
  misc_feature (1)...(28): n = A,T,C or G
tgtggatatgtgcntttcctgtctccct

SEQ ID NO: 309 - DNA, 30 bp, Homo sapiens
  misc_feature (1)...(30): n = A,T,C or G
ctcagtcccagaaaccntatgtactgtgac

SEQ ID NO: 310 - DNA, 40 bp, Homo sapiens
  misc_feature (1)...(40): n = A,T,C or G
ctcagtcccagaaaccatatgnactgtgaccccgctcact

SEQ ID NO: 311 - DNA, 34 bp, Homo sapiens
  misc_feature (1)...(34): n = A,T,C or G
tctctactaaaaaanaactaaccaggcgtggtgg

SEQ ID NO: 312 - DNA, 21 bp, Homo sapiens
  misc_feature (1)...(21): n = A,T,C or G
ggaacagaggnatagacagga

SEQ ID NO: 313 - DNA, 18 bp, Homo sapiens
  misc_feature (1)...(18): n = A,T,C or G
agactctgtctcnaaaaa

SEQ ID NO: 314 - DNA, 29 bp, Homo sapiens
  misc_feature (1)...(29): n = A,T,C or G
atcattctaagganctgacagtgcttctg

SEQ ID NO: 315 - DNA, 21 bp, Homo sapiens
  misc_feature (1)...(21): n = A,T,C or G
gaagctaatangcaaaccatc

SEQ ID NO: 316 - DNA, 21 bp, Homo sapiens
  misc_feature (1)...(21): n = A,T,C or G
acctcaaagtntggctggata

SEQ ID NO: 317 - DNA, 21 bp, Homo sapiens
  misc_feature (1)...(21): n = A,T,C or G
gtaagacacangcctgcagag

SEQ ID NO: 318 - DNA, 31 bp, Homo sapiens
  misc_feature (1)...(31): n = A,T,C or G
aagacaacctagtctnctgttctgctttaaa

SEQ ID NO: 319 - DNA, 29 bp, Homo sapiens
  misc_feature (1)...(29): n = A,T,C or G
tgagttcttacacagtggtnaaacaaaca

SEQ ID NO: 320 - DNA, 18 bp, Homo sapiens
  misc_feature (1)...(18): n = A,T,C or G
tgcttggctngttgggat

SEQ ID NO: 321 - DNA, 32 bp, Homo sapiens
  misc_feature (1)...(32): n = A,T,C or G
cacgtattaaagccacctacnatataccaccc

SEQ ID NO: 322 - DNA, 35 bp, Homo sapiens
  misc_feature (1)...(35): n = A,T,C or G
gagggccaaaggctttgtcctgccnctcctgccct

SEQ ID NO: 323 - DNA, 27 bp, Homo sapiens
  misc_feature (1)...(27): n = A,T,C or G
tctgatagtggcnggaacatcctgact

SEQ ID NO: 324 - DNA, 19 bp, Homo sapiens
  misc_feature (1)...(19): n = A,T,C or G
tgtggggctttgcnttttt

SEQ ID NO: 325 - DNA, 35 bp, Homo sapiens
  misc_feature (1)...(35): n = A,T,C or G
gacccctgcttacatngtacataacaatagctata

SEQ ID NO: 326 - DNA, 29 bp, Homo sapiens
  misc_feature (1)...(29): n = A,T,C or G
ggcagggntgtctggcaagggaccagtcc

SEQ ID NO: 327 - DNA, 31 bp, Homo sapiens
  misc_feature (1)...(31): n = A,T,C or G
acacttattntaactgtcaccctgggcccat

SEQ ID NO: 328 - DNA, 34 bp, Homo sapiens
  misc_feature (1)...(34): n = A,T,C or G
gctattttcttcnttgtattctgcagtgaccagg

SEQ ID NO: 329 - DNA, 28 bp, Homo sapiens
  misc_feature (1)...(28): n = A,T,C or G
ttgacaaacacttattntaactgtcacc

SEQ ID NO: 330 - DNA, 31 bp, Homo sapiens
  misc_feature (1)...(31): n = A,T,C or G
cattcactgtgctgttcngggctagagaaga

SEQ ID NO: 331 - DNA, 38 bp, Homo sapiens
  misc_feature (1)...(38): n = A,T,C or G
cactgctgctctgcagtgacncctgcttccccctaagt

SEQ ID NO: 332 - DNA, 38 bp, Homo sapiens
  misc_feature (1)...(38): n = A,T,C or G
gtgaccctattggatcttctcangccactgagggatat

SEQ ID NO: 333 - DNA, 33 bp, Homo sapiens
  misc_feature (1)...(33): n = A,T,C or G
caagagggaatggagtctttngcagaggggctg

SEQ ID NO: 334 - DNA, 31 bp, Homo sapiens
  misc_feature (1)...(31): n = A,T,C or G
cttctgcttctgcttctgncccttctgcctc

SEQ ID NO: 335 - DNA, 34 bp, Homo sapiens
  misc_feature (1)...(34): n = A,T,C or G
gagtgtggtttgagaagantctgaggagtgggac

SEQ ID NO: 336 - DNA, 28 bp, Homo sapiens
  misc_feature (1)...(28): n = A,T,C or G
tttttaaagactagtcnctgggcgcggt

SEQ ID NO: 337 - DNA, 36 bp, Homo sapiens
  misc_feature (1)...(36): n = A,T,C or G
gagaatggcgtgaacccgggaggnagagcttgcagt

SEQ ID NO: 338 - DNA, 37 bp, Homo sapiens
  misc_feature (1)...(37): n = A,T,C or G
aagcgagactccatctcnaaaaaaaaacaaaaaacaa

SEQ ID NO: 339 - DNA, 35 bp, Homo sapiens
  misc_feature (1)...(35): n = A,T,C or G
gagcttgcagtgagctganatcgcgccactgcact

SEQ ID NO: 340 - DNA, 30 bp, Homo sapiens
  misc_feature (1)...(30): n = A,T,C or G
gaagtgaaaaccaaatncaagggctacaga

SEQ ID NO: 341 - DNA, 21 bp, Homo sapiens
  misc_feature (1)...(21): n = A,T,C or G
ttgcaaccctngcaaaggtaa

SEQ ID NO: 342 - DNA, 28 bp, Homo sapiens
  misc_feature (1)...(28): n = A,T,C or G
catacacaagaangagttccatttactg

SEQ ID NO: 343 - DNA, 38 bp, Homo sapiens
  misc_feature (1)...(38): n = A,T,C or G
aaaacaaacaaacaaacaaacaaanacactgtcatgcc

SEQ ID NO: 344 - DNA, 22 bp, Homo sapiens
  misc_feature (1)...(22): n = A,T,C or G
ggcaaataatnacatggatctc

SEQ ID NO: 345 - DNA, 21 bp, Homo sapiens
  misc_feature (1)...(21): n = A,T,C or G
agttggcagnggggctggttc

SEQ ID NO: 346 - DNA, 24 bp, Homo sapiens
  misc_feature (1)...(24): n = A,T,C or G
aaactgtgatttncagtttcattt

SEQ ID NO: 347 - DNA, 24 bp, Homo sapiens
  misc_feature (1)...(24): n = A,T,C or G
ccctcagagggcnggtactggact

SEQ ID NO: 348 - DNA, 36 bp, Homo sapiens
  misc_feature (1)...(36): n = A,T,C or G
cttcatctctccctgccaangaagctggtggtgccc

SEQ ID NO: 349 - DNA, 25 bp, Homo sapiens
  misc_feature (1)...(25): n = A,T,C or G
agccactacttgggcngctcagctc

SEQ ID NO: 350 - DNA, 31 bp, Homo sapiens
  misc_feature (1)...(31): n = A,T,C or G
cacacttctcccacnagaaataaagcaagca

SEQ ID NO: 351 - DNA, 28 bp, Homo sapiens
  misc_feature (1)...(28): n = A,T,C or G
agcaagcagctgttnctctcttgggccc

SEQ ID NO: 352 - DNA, 25 bp, Homo sapiens
  misc_feature (1)...(25): n = A,T,C or G
agcctgagcctngcgcagcccagac

SEQ ID NO: 353 - DNA, 29 bp, Homo sapiens
  misc_feature (1)...(29): n = A,T,C or G
acacacacacacanttttttgagagagag

SEQ ID NO: 354 - DNA, 35 bp, Homo sapiens
  misc_feature (1)...(35): n = A,T,C or G
atgtgtagtgtgtgagaangtgtgagaggtactcg

SEQ ID NO: 355 - DNA, 32 bp, Homo sapiens
  misc_feature (1)...(32): n = A,T,C or G
ttatgttccattgtacntattcaccatatttt

SEQ ID NO: 356 - DNA, 27 bp, Homo sapiens
  misc_feature (1)...(27): n = A,T,C or G
atccactcctcntgtcatggacatctg

SEQ ID NO: 357 - DNA, 33 bp, Homo sapiens
  misc_feature (1)...(33): n = A,T,C or G
tctaaagaaaaagaaagcngtgaattcttggac

SEQ ID NO: 358 - DNA, 35 bp, Homo sapiens
  misc_feature (1)...(35): n = A,T,C or G
gctctgtgccaggcaggggnctccgaggtgagtgt

SEQ ID NO: 359 - DNA, 32 bp, Homo sapiens
  misc_feature (1)...(32): n = A,T,C or G
ccaggcagggggctccgnggtgagtgtggcct

SEQ ID NO: 360 - DNA, 34 bp, Homo sapiens
  misc_feature (1)...(34): n = A,T,C or G
agagaagggaactggcntgtgtggctgggctgtg

SEQ ID NO: 361 - DNA, 34 bp, Homo sapiens
  misc_feature (1)...(34): n = A,T,C or G
gcaggctcagtggaaggagaggngtctccttatg

SEQ ID NO: 362 - DNA, 32 bp, Homo sapiens
  misc_feature (1)...(32): n = A,T,C or G
atggggaactctcctanactgctggaggcgtg

SEQ ID NO: 363 - DNA, 27 bp, Homo sapiens
  misc_feature (1)...(27): n = A,T,C or G
agtcatggcactanatggagcccaggg

SEQ ID NO: 364 - DNA, 27 bp, Homo sapiens
  misc_feature (1)...(27): n = A,T,C or G
caccaggaggttcagcncccactgtgg

SEQ ID NO: 365 - DNA, 26 bp, Homo sapiens
  misc_feature (1)...(26): n = A,T,C or G
gcatcccagcgccnggccagtggtcc

SEQ ID NO: 366 - DNA, 30 bp, Homo sapiens
  misc_feature (1)...(30): n = A,T,C or G
gagtaaggggtcnaggagggggggggtggc

SEQ ID NO: 367 - DNA, 26 bp, Homo sapiens
  misc_feature (1)...(26): n = A,T,C or G
gaacatactcatanccatgcttcccc

SEQ ID NO: 368 - DNA, 27 bp, Homo sapiens
  misc_feature (1)...(27): n = A,T,C or G
tacacttatggtttgtgcntttttttt

SEQ ID NO: 369 - DNA, 24 bp, Homo sapiens
  misc_feature (1)...(24): n = A,T,C or G
tatggtttgtgcnttttttttttt

SEQ ID NO: 370 - DNA, 31 bp, Homo sapiens
  misc_feature (1)...(31): n = A,T,C or G
gcagggtggggagaangccagactcagggtg

SEQ ID NO: 371 - DNA, 26 bp, Homo sapiens
  misc_feature (1)...(26): n = A,T,C or G
ggcccagccccccccnggaagtggat

SEQ ID NO: 372 - DNA, 27 bp, Homo sapiens
  misc_feature (1)...(27): n = A,T,C or G
gtaaaaaaaaanccctacaggtaaaag

SEQ ID NO: 373 - DNA, 29 bp, Homo sapiens
  misc_feature (1)...(29): n = A,T,C or G
cccccatgtgccangtcacctcccttgtc

SEQ ID NO: 374 - DNA, 22 bp, Homo sapiens
  misc_feature (1)...(22): n = A,T,C or G
cccagcaggaaacanatgcaca

SEQ ID NO: 375 - DNA, 26 bp, Homo sapiens
  misc_feature (1)...(26): n = A,T,C or G
gaacccagagagaccngtaggagggg

SEQ ID NO: 376 - DNA, 26 bp, Homo sapiens
  misc_feature (1)...(26): n = A,T,C or G
gcccggcagagtcaccngggctggcc

SEQ ID NO: 377 - DNA, 25 bp, Homo sapiens
  misc_feature (1)...(25): n = A,T,C or G
aaatggggccaggngcggtggctca

SEQ ID NO: 378 - DNA, 34 bp, Homo sapiens
  misc_feature (1)...(34): n = A,T,C or G
cctgtcttaaaaaaaaaannngctgggtgtggtg

SEQ ID NO: 379 - DNA, 28 bp, Homo sapiens
  misc_feature (1)...(28): n = A,T,C or G
aattgcttgaacccnggaggcagaggtt

SEQ ID NO: 380 - DNA, 31 bp, Homo sapiens
  misc_feature (1)...(31): n = A,T,C or G
ccaaccaaccanccaaatggtattaactctc

SEQ ID NO: 381 - DNA, 24 bp, Homo sapiens
  misc_feature (1)...(24): n = A,T,C or G
cacttaccttgcccngccccaccc

SEQ ID NO: 382 - DNA, 27 bp, Homo sapiens
  misc_feature (1)...(27): n = A,T,C or G
tccttccttgaacctntgtggatttct

SEQ ID NO: 383 - DNA, 28 bp, Homo sapiens
  misc_feature (1)...(28): n = A,T,C or G
tggtcaacagtcccanctgagcccagcc

SEQ ID NO: 384 - DNA, 29 bp, Homo sapiens
  misc_feature (1)...(29): n = A,T,C or G
cttgaggtgcctcntaagaggtccaatga

SEQ ID NO: 385 - DNA, 30 bp, Homo sapiens
  misc_feature (1)...(30): n = A,T,C or G
ttattccagtcacctngagtcattccagtc

SEQ ID NO: 386 - DNA, 30 bp, Homo sapiens
  misc_feature (1)...(30): n = A,T,C or G
agggaagaagaagaancaagaggaagagga

SEQ ID NO: 387 - DNA, 32 bp, Homo sapiens
  misc_feature (1)...(32): n = A,T,C or G
gaaagccaaaattaaaaaaaaantcaacagaa

SEQ ID NO: 388 - DNA, 30 bp, Homo sapiens
  misc_feature (1)...(30): n = A,T,C or G
agtcaggctgtctcggcngctaaaagaggc

SEQ ID NO: 389 - DNA, 29 bp, Homo sapiens
  misc_feature (1)...(29): n = A,T,C or G
tgcttggtggggctcnagcgttaccgccg

SEQ ID NO: 390 - DNA, 28 bp, Homo sapiens
  misc_feature (1)...(28): n = A,T,C or G
ttcacccattgttctcnctattcccttt

SEQ ID NO: 391 - DNA, 32 bp, Homo sapiens
  misc_feature (1)...(32): n = A,T,C or G
acttacctgctgaaatgcactgnttttttttt

SEQ ID NO: 392 - DNA, 36 bp, Homo sapiens
  misc_feature (1)...(36): n = A,T,C or G
taatgacattcccttgtangaatgtgccaatgtgga

SEQ ID NO: 393 - DNA, 22 bp, Homo sapiens
  misc_feature (1)...(22): n = A,T,C or G
gatcacattanttgcctgagtt

SEQ ID NO: 394 - DNA, 29 bp, Homo sapiens
  misc_feature (1)...(29): n = A,T,C or G
ttgcctgagttcncaagttggttaagaga

SEQ ID NO: 395 - DNA, 33 bp, Homo sapiens
  misc_feature (1)...(33): n = A,T,C or G
tctcatcaataaatatttatnnncttcatcatt

SEQ ID NO: 396 - DNA, 25 bp, Homo sapiens
  misc_feature (1)...(25): n = A,T,C or G
aaaaaaaaaaaaanggccaggcgcg

SEQ ID NO: 397 - DNA, 26 bp, Homo sapiens
  misc_feature (1)...(26): n = A,T,C or G
aaaaaaaaaangccctagaccctctg

SEQ ID NO: 398 - DNA, 27 bp, Homo sapiens
  misc_feature (1)...(27): n = A,T,C or G
ttgggaggctgaggcngaagaatcgct

SEQ ID NO: 399 - DNA, 25 bp, Homo sapiens
  misc_feature (1)...(25): n = A,T,C or G
agattgtgccactgngcttcagtct

SEQ ID NO: 400 - DNA, 28 bp, Homo sapiens
  misc_feature (1)...(28): n = A,T,C or G
gggagacccggagggagntagggaagtg

SEQ ID NO: 401 - DNA, 27 bp, Homo sapiens
  misc_feature (1)...(27): n = A,T,C or G
caacagcctggcagngagggcctgtct

SEQ ID NO: 402 - DNA, 33 bp, Homo sapiens
  misc_feature (1)...(33): n = A,T,C or G
actagagggttttttanagagaagtgacatgat

SEQ ID NO: 403 - DNA, 37 bp, Homo sapiens
  misc_feature (1)...(37): n = A,T,C or G
taaggaatacggttttgnacgtaagtgtgagatgcct

SEQ ID NO: 404 - DNA, 27 bp, Homo sapiens
  misc_feature (1)...(27): n = A,T,C or G
caggtggaantgtgaatctggggagag

SEQ ID NO: 405 - DNA, 19 bp, Homo sapiens
  misc_feature (1)...(19): n = A,T,C or G
aagactctgtctcnaaaaa

SEQ ID NO: 406 - DNA, 31 bp, Homo sapiens
  misc_feature (1)...(31): n = A,T,C or G
cccagaatagagaccacntccatcctccctt

SEQ ID NO: 407 - DNA, 31 bp, Homo sapiens
  misc_feature (1)...(31): n = A,T,C or G
gaacttagatttgcgncccttagcattcaac

SEQ ID NO: 408 - DNA, 28 bp, Homo sapiens
  misc_feature (1)...(28): n = A,T,C or G
caatgcatgatcctntctgagcctcagc

SEQ ID NO: 409 - DNA, 26 bp, Homo sapiens
  misc_feature (1)...(26): n = A,T,C or G
ttgatactcagtangtacagcttatt

SEQ ID NO: 410 - DNA, 23 bp, Homo sapiens
  misc_feature (1)...(23): n = A,T,C or G
caggcaacaaantctccctccct

SEQ ID NO: 411 - DNA, 26 bp, Homo sapiens
  misc_feature (1)...(26): n = A,T,C or G
ccttgcttcaantgcttcagtctatc

SEQ ID NO: 412 - DNA, 21 bp, Homo sapiens
  misc_feature (1)...(21): n = A,T,C or G
ccaaaggtcncaggctctggc

SEQ ID NO: 413 - DNA, 28 bp, Homo sapiens
  misc_feature (1)...(28): n = A,T,C or G
ccattccctgagcncaggttgcctttct

SEQ ID NO: 414 - DNA, 31 bp, Homo sapiens
  misc_feature (1)...(31): n = A,T,C or G
ggccaggctggtctcngtctagactcaagtg

SEQ ID NO: 415 - DNA, 37 bp, Homo sapiens
  misc_feature (1)...(37): n = A,T,C or G
tgtttgagacagggtcttgntctgtcgtccaggatgg

SEQ ID NO: 416 - DNA, 18 bp, Homo sapiens
  misc_feature (1)...(18): n = A,T,C or G
atgcccagctantttttt

SEQ ID NO: 417 - DNA, 34 bp, Homo sapiens
  misc_feature (1)...(34): n = A,T,C or G
ccaccgcacccggccanttttatttgtttttaaa

SEQ ID NO: 418 - DNA, 34 bp, Homo sapiens
  misc_feature (1)...(34): n = A,T,C or G
ttgccaacatttggtatnatcagtcttcaatttt

SEQ ID NO: 419 - DNA, 29 bp, Homo sapiens
  misc_feature (1)...(29): n = A,T,C or G
ttttttttttnctgagacagagtctcgct

SEQ ID NO: 420 - DNA, 20 bp, Homo sapiens
  misc_feature (1)...(20): n = A,T,C or G
caattgacttccctnaaaaa

SEQ ID NO: 421 - DNA, 31 bp, Homo sapiens
  misc_feature (1)...(31): n = A,T,C or G
aagggtgtgcctagngcacacactccctccc

SEQ ID NO: 422 - DNA, 28 bp, Homo sapiens
  misc_feature (1)...(28): n = A,T,C or G
aataaagtgattacttnaaaaaaaaaaa

SEQ ID NO: 423 - DNA, 26 bp, Homo sapiens
  misc_feature (1)...(26): n = A,T,C or G
gagggcctgacagnttgaaggggttg

SEQ ID NO: 424 - DNA, 22 bp, Homo sapiens
  misc_feature (1)...(22): n = A,T,C or G
cctctggggtntttccaaatca

SEQ ID NO: 425 - DNA, 30 bp, Homo sapiens
  misc_feature (1)...(30): n = A,T,C or G
ttgccagaacacngggtcagagagcaagag

SEQ ID NO: 426 - DNA, 31 bp, Homo sapiens
agagtgagactctgtctcaaaaaaaaaaaaa

SEQ ID NO: 427 - DNA, 26 bp, Homo sapiens
  misc_feature (1)...(26): n = A,T,C or G
cttcatatctacttngaaaaccatat

SEQ ID NO: 428 - DNA, 19 bp, Homo sapiens
  misc_feature (1)...(19): n = A,T,C or G
gagactctgtctcnaaaaa

SEQ ID NO: 429 - DNA, 26 bp, Homo sapiens
  misc_feature (1)...(26): n = A,T,C or G
aaaaaaaaaaangaacctctgtcgta

SEQ ID NO: 430 - DNA, 28 bp, Homo sapiens
  misc_feature (1)...(28): n = A,T,C or G
acttccagattaatangtcttaacccat

SEQ ID NO: 431 - DNA, 29 bp, Homo sapiens
  misc_feature (1)...(29): n = A,T,C or G
tgctgtagctccatttgagnagggacctt

SEQ ID NO: 432 - DNA, 19 bp, Homo sapiens
  misc_feature (1)...(19): n = A,T,C or G
atgatttgcntcaaagcag

SEQ ID NO: 433 - DNA, 30 bp, Homo sapiens
  misc_feature (1)...(30): n = A,T,C or G
tcagtaccacatctgtntttccatgctctt

SEQ ID NO: 434 - DNA, 31 bp, Homo sapiens
  misc_feature (1)...(31): n = A,T,C or G
acagaggtaaaagtgttttgaaagcnaaaaa

SEQ ID NO: 435 - DNA, 20 bp, Homo sapiens
  misc_feature (1)...(20): n = A,T,C or G
ctagcctanggtctaggccc

SEQ ID NO: 436 - DNA, 20 bp, Homo sapiens
  misc_feature (1)...(20): n = A,T,C or G
ggtctaggcnctcctgcctg

SEQ ID NO: 437 - DNA, 23 bp, Homo sapiens
  misc_feature (1)...(23): n = A,T,C or G
ggaatcattacntatcacaatca

SEQ ID NO: 438 - DNA, 26 bp, Homo sapiens
  misc_feature (1)...(26): n = A,T,C or G
accatggatgcntagctgagttcctg

SEQ ID NO: 439 - DNA, 27 bp, Homo sapiens
  misc_feature (1)...(27): n = A,T,C or G
acagttgtccctnagcatcttcgagga

SEQ ID NO: 440 - DNA, 40 bp, Homo sapiens
  misc_feature (1)...(40): n = A,T,C or G
gagacttcatctnaaaaacaaaaaacaaacaaacaaaaaa

SEQ ID NO: 441 - DNA, 29 bp, Homo sapiens
  misc_feature (1)...(29): n = A,T,C or G
aaactctcaccacnactgaaatctggtta

SEQ ID NO: 442 - DNA, 27 bp, Homo sapiens
  misc_feature (1)...(27): n = A,T,C or G
ccctggggctctantatttggtgttac

SEQ ID NO: 443 - DNA, 24 bp, Homo sapiens
  misc_feature (1)...(24): n = A,T,C or G
gaaagatatanaaattaaattaaa

SEQ ID NO: 444 - DNA, 30 bp, Homo sapiens
  misc_feature (1)...(30): n = A,T,C or G
aaaaantcataccaattagtctcacttaaa

SEQ ID NO: 445 - DNA, 20 bp, Homo sapiens
  misc_feature (1)...(20): n = A,T,C or G
catcctgcanccccagcttc

SEQ ID NO: 446 - DNA, 39 bp, Homo sapiens
  misc_feature (1)...(39): n = A,T,C or G
cagaacaaattagagaaaaactccngtcaggctctccac

SEQ ID NO: 447 - DNA, 28 bp, Homo sapiens
  misc_feature (1)...(28): n = A,T,C or G
acaacaacgggtanatattttaggtctc

SEQ ID NO: 448 - DNA, 21 bp, Homo sapiens
  misc_feature (1)...(21): n = A,T,C or G
attattagtcnaataatcacc

SEQ ID NO: 449 - DNA, 22 bp, Homo sapiens
  misc_feature (1)...(22): n = A,T,C or G
aaggcggggtncagtggctcac

SEQ ID NO: 450 - DNA, 29 bp, Homo sapiens
  misc_feature (1)...(29): n = A,T,C or G
ctgaggcaggtggatcatntgaggtcagg

SEQ ID NO: 451 - DNA, 28 bp, Homo sapiens
  misc_feature (1)...(28): n = A,T,C or G
tggaagagacatgcatncaaaccatatc

SEQ ID NO: 452 - DNA, 22 bp, Homo sapiens
  misc_feature (1)...(22): n = A,T,C or G
tttttttttttnccgtgaacag

SEQ ID NO: 453 - DNA, 27 bp, Homo sapiens
  misc_feature (1)...(27): n = A,T,C or G
acaggcgcgcncacacacacacacaca

SEQ ID NO: 454 - DNA, 27 bp, Homo sapiens
  misc_feature (1)...(27): n = A,T,C or G
taaaaattattcgngagaattttagaa

SEQ ID NO: 455 - DNA, 30 bp, Homo sapiens
  misc_feature (1)...(30): n = A,T,C or G
ccaagtaccttggnctgtactgagagatga

SEQ ID NO: 456 - DNA, 24 bp, Homo sapiens
  misc_feature (1)...(24): n = A,T,C or G
acaaacaaacaancaaaccttatt

SEQ ID NO: 457 - DNA, 18 bp, Homo sapiens
  misc_feature (1)...(18): n = A,T,C or G
aaatatagncaaaatact

SEQ ID NO: 458 - DNA, 24 bp, Homo sapiens
  misc_feature (1)...(24): n = A,T,C or G
tcctggccaacntggtgaaacccc

SEQ ID NO: 459 - DNA, 22 bp, Homo sapiens
  misc_feature (1)...(22): n = A,T,C or G
ggaaaaaaaaancacacatgat

SEQ ID NO: 460 - DNA, 24 bp, Homo sapiens
  misc_feature (1)...(24): n = A,T,C or G
ataaaaaaaaangatttattatgt

SEQ ID NO: 461 - DNA, 17 bp, Homo sapiens
  misc_feature (1)...(17): n = A,T,C or G
agtttcngtttagaaag

SEQ ID NO: 462 - DNA, 23 bp, Homo sapiens
  misc_feature (1)...(23): n = A,T,C or G
acttaagagantcaaataatttt

SEQ ID NO: 463 - DNA, 21 bp, Homo sapiens
  misc_feature (1)...(21): n = A,T,C or G
ttttaaaacttntaaaggaat

SEQ ID NO: 464 - DNA, 36 bp, Homo sapiens
  misc_feature (1)...(36): n = A,T,C or G
tgtttctttttttctttcttntttttttagacggag

SEQ ID NO: 465 - DNA, 31 bp, Homo sapiens
  misc_feature (1)...(31): n = A,T,C or G
tggggccaaaaatctcntctgacttccagtg

SEQ ID NO: 466 - DNA, 30 bp, Homo sapiens
  misc_feature (1)...(30): n = A,T,C or G
tcccaaggtcacatngttactatgtatgtt

SEQ ID NO: 467 - DNA, 29 bp, Homo sapiens
  misc_feature (1)...(29): n = A,T,C or G
gaagcaagactgtcnggaacactggactc

SEQ ID NO: 468 - DNA, 33 bp, Homo sapiens
  misc_feature (1)...(33): n = A,T,C or G
aaccatctgtttgtgtcntgaggctctctgtat

SEQ ID NO: 469 - DNA, 31 bp, Homo sapiens
  misc_feature (1)...(31): n = A,T,C or G
tgatgatcacgcaacncagctgaagaatgat

SEQ ID NO: 470 - DNA, 39 bp, Homo sapiens
  misc_feature (1)...(39): n = A,T,C or G
ccatcctaaatactacaagatgcntttgacgctataaga

SEQ ID NO: 471 - DNA, 29 bp, Homo sapiens
  misc_feature (1)...(29): n = A,T,C or G
aaagtcaaaaaatcnaaaggagatgagca

SEQ ID NO: 472 - DNA, 31 bp, Homo sapiens
  misc_feature (1)...(31): n = A,T,C or G
ttctgggaaaaggaagtcntttttttttttt

SEQ ID NO: 473 - DNA, 34 bp, Homo sapiens
  misc_feature (1)...(34): n = A,T,C or G
taatctctgcctcccaggntcaagtgattcttct

SEQ ID NO: 474 - DNA, 33 bp, Homo sapiens
  misc_feature (1)...(33): n = A,T,C or G
gtatttttagtagagacngggtttccttatgtt

SEQ ID NO: 475 - DNA, 30 bp, Homo sapiens
  misc_feature (1)...(30): n = A,T,C or G
tcaccagcaacctgttntgagtgaatcatc

SEQ ID NO: 476 - DNA, 34 bp, Homo sapiens
  misc_feature (1)...(34): n = A,T,C or G
aaaaagttttttttttttnctaccaaatgtacag

SEQ ID NO: 477 - DNA, 31 bp, Homo sapiens
  misc_feature (1)...(31): n = A,T,C or G
attacattataatttacangcatgatctaat

SEQ ID NO: 478 - DNA, 26 bp, Homo sapiens
  misc_feature (1)...(26): n = A,T,C or G
ccaagaaagaggntgtcatggggtaa

SEQ ID NO: 479 - DNA, 25 bp, Homo sapiens
  misc_feature (1)...(25): n = A,T,C or G
gtggaggctganagtaggcgagttt

SEQ ID NO: 480 - DNA, 34 bp, Homo sapiens
  misc_feature (1)...(34): n = A,T,C or G
tgcctccaagaaagaggntgtcatggggtaaacc

SEQ ID NO: 481 - DNA, 40 bp, Homo sapiens
  misc_feature (1)...(40): n = A,T,C or G
tcctttcattttagcctgaaagactccctttagcantttt

SEQ ID NO: 482 - DNA, 23 bp, Homo sapiens
  misc_feature (1)...(23): n = A,T,C or G
tgccatgttggtntgctgcaccc

SEQ ID NO: 483 - DNA, 36 bp, Homo sapiens
  misc_feature (1)...(36): n = A,T,C or G
tatttttttttttttaagtacnttaagttctagggt

SEQ ID NO: 484 - DNA, 21 bp, Homo sapiens
  misc_feature (1)...(21): n = A,T,C or G
gttctagatccntgaggaatc

SEQ ID NO: 485 - DNA, 23 bp, Homo sapiens
  misc_feature (1)...(23): n = A,T,C or G
ttccacaatggtngaactagttt

SEQ ID NO: 486 - DNA, 23 bp, Homo sapiens
  misc_feature (1)...(23): n = A,T,C or G
gttcatatacttntcccctgttt

SEQ ID NO: 487 - DNA, 26 bp, Homo sapiens
  misc_feature (1)...(26): n = A,T,C or G
tttgctgaagttgnttatcaacttaa

SEQ ID NO: 488 - DNA, 27 bp, Homo sapiens
  misc_feature (1)...(27): n = A,T,C or G
atatgatgcattacntttatcgatttg

SEQ ID NO: 489 - DNA, 23 bp, Homo sapiens
  misc_feature (1)...(23): n = A,T,C or G
ccttgtcttgtgcnggttttcaa

SEQ ID NO: 490 - DNA, 16 bp, Homo sapiens
  misc_feature (1)...(16): n = A,T,C or G
ttattgccncaatttc

SEQ ID NO: 491 - DNA, 22 bp, Homo sapiens
  misc_feature (1)...(22): n = A,T,C or G
ttggttgatangctattaatta

SEQ ID NO: 492 - DNA, 20 bp, Homo sapiens
  misc_feature (1)...(20): n = A,T,C or G
tgttgattttngatgtttcc

SEQ ID NO: 493 - DNA, 25 bp, Homo sapiens
  misc_feature (1)...(25): n = A,T,C or G
actgctttgaatgngtcccagattc

SEQ ID NO: 494 - DNA, 28 bp, Homo sapiens
  misc_feature (1)...(28): n = A,T,C or G
ttgtgtctttgttctcnttggtttcaaa

SEQ ID NO: 495 - DNA, 21 bp, Homo sapiens
  misc_feature (1)...(21): n = A,T,C or G
gcggttttgantgagtttctt

SEQ ID NO: 496 - DNA, 21 bp, Homo sapiens
  misc_feature (1)...(21): n = A,T,C or G
ttttttttgntttccatttgc

SEQ ID NO: 497 - DNA, 16 bp, Homo sapiens
  misc_feature (1)...(16): n = A,T,C or G
cccctgcntttttttg

SEQ ID NO: 498 - DNA, 26 bp, Homo sapiens
  misc_feature (1)...(26): n = A,T,C or G
tttatgaatctgggngctcctgtatt

SEQ ID NO: 499 - DNA, 23 bp, Homo sapiens
  misc_feature (1)...(23): n = A,T,C or G
ttcaggagctcttntaaggcagg

SEQ ID NO: 500 - DNA, 18 bp, Homo sapiens
  misc_feature (1)...(18): n = A,T,C or G
ggcctggnggtgacaaaa

SEQ ID NO: 501 - DNA, 22 bp, Homo sapiens
  misc_feature (1)...(22): n = A,T,C or G
attttatttcnccttcacttat

SEQ ID NO: 502 - DNA, 24 bp, Homo sapiens
  misc_feature (1)...(24): n = A,T,C or G
cagagagatccnctgttagtctga

SEQ ID NO: 503 - DNA, 24 bp, Homo sapiens
  misc_feature (1)...(24): n = A,T,C or G
agagtatctttntggtgttctctg

SEQ ID NO: 504 - DNA, 24 bp, Homo sapiens
  misc_feature (1)...(24): n = A,T,C or G
atttcctgaanttgaatgttggcc

SEQ ID NO: 505 - DNA, 31 bp, Homo sapiens
  misc_feature (1)...(31): n = A,T,C or G
gtctaactagtcccancgagatgagccgggt

SEQ ID NO: 506 - DNA, 26 bp, Homo sapiens
  misc_feature (1)...(26): n = A,T,C or G
cagtagacgaacnatgcaaaatacca

SEQ ID NO: 507 - DNA, 25 bp, Homo sapiens
  misc_feature (1)...(25): n = A,T,C or G
tcctggggctttnacgtttttagtg

SEQ ID NO: 508 - DNA, 26 bp, Homo sapiens
  misc_feature (1)...(26): n = A,T,C or G
cagagataagaantagtttccaagaa

SEQ ID NO: 509 - DNA, 24 bp, Homo sapiens
  misc_feature (1)...(24): n = A,T,C or G
acaggcttngacagaggacttgga

SEQ ID NO: 510 - DNA, 34 bp, Homo sapiens
  misc_feature (1)...(34): n = A,T,C or G
tcactaaattctagaaanaaagattctaggcagt

SEQ ID NO: 511 - DNA, 29 bp, Homo sapiens
  misc_feature (1)...(29): n = A,T,C or G
taggcagttgctgntatttaaaaaatcat

SEQ ID NO: 512 - DNA, 28 bp, Homo sapiens
  misc_feature (1)...(28): n = A,T,C or G
caggactaaagtganctactctgaaaga

SEQ ID NO: 513 - DNA, 40 bp, Homo sapiens
  misc_feature (1)...(40): n = A,T,C or G
tttttggacacacacaatgacactncacttagagaagtgc

SEQ ID NO: 514 - DNA, 32 bp, Homo sapiens
  misc_feature (1)...(32): n = A,T,C or G
acaaacaaataaacantaaaacaaaacccaca

SEQ ID NO: 515 - DNA, 28 bp, Homo sapiens
  misc_feature (1)...(28): n = A,T,C or G
cagagtgattctgtgtttnaaaaaaaaa

SEQ ID NO: 516 - DNA, 28 bp, Homo sapiens
  misc_feature (1)...(28): n = A,T,C or G
acagcaaaggcctttnactgaaggactc

SEQ ID NO: 517 - DNA, 29 bp, Homo sapiens
  misc_feature (1)...(29): n = A,T,C or G
aggggcggttgcagnagaagagctgggcc

SEQ ID NO: 518 - DNA, 31 bp, Homo sapiens
  misc_feature (1)...(31): n = A,T,C or G
ggttataataattttncgttcatcagacctc

SEQ ID NO: 519 - DNA, 27 bp, Homo sapiens
  misc_feature (1)...(27): n = A,T,C or G
tgtgggggaagggnctatagccaagat

SEQ ID NO: 520 - DNA, 28 bp, Homo sapiens
  misc_feature (1)...(28): n = A,T,C or G
gcactttcctcaanctggagaccaccag

SEQ ID NO: 521 - DNA, 30 bp, Homo sapiens
  misc_feature (1)...(30): n = A,T,C or G
ggccatcagaatctcnagttgatcttctaa

SEQ ID NO: 522 - DNA, 24 bp, Homo sapiens
  misc_feature (1)...(24): n = A,T,C or G
tcctgctaaggntctgtgaggccc

SEQ ID NO: 523 - DNA, 26 bp, Homo sapiens
  misc_feature (1)...(26): n = A,T,C or G
catctagggtgtangttccatgaggg

SEQ ID NO: 524 - DNA, 32 bp, Homo sapiens
  misc_feature (1)...(32): n = A,T,C or G
cggtacttgtggagcanagaggtggctcccaa

SEQ ID NO: 525 - DNA, 37 bp, Homo sapiens
  misc_feature (1)...(37): n = A,T,C or G
taacccaccaggctccagangtcgcctagaatcccag

SEQ ID NO: 526 - DNA, 38 bp, Homo sapiens
  misc_feature (1)...(38): n = A,T,C or G
agatctggagagattccccacnagagtccatatttccc

SEQ ID NO: 527 - DNA, 34 bp, Homo sapiens
  misc_feature (1)...(34): n = A,T,C or G
cagagactttgtctgagnaaaaaaaaaagaaaaa

SEQ ID NO: 528 - DNA, 29 bp, Homo sapiens
  misc_feature (1)...(29): n = A,T,C or G
gaaaaaaaggaaaaanattagcatgttta

SEQ ID NO: 529 - DNA, 38 bp, Homo sapiens
  misc_feature (1)...(38): n = A,T,C or G
gctatcaatatcaaggcacttgagngctctatggatat

SEQ ID NO: 530 - DNA, 20 bp, Homo sapiens
  misc_feature (1)...(20): n = A,T,C or G
aaaaagaaaaanaaagaaaa

SEQ ID NO: 531 - DNA, 29 bp, Homo sapiens
  misc_feature (1)...(29): n = A,T,C or G
aaaaattagccaagtgnggtggcaggcac

SEQ ID NO: 532 - DNA, 29 bp, Homo sapiens
  misc_feature (1)...(29): n = A,T,C or G
gcacatggggcacanggtcacactcacca

SEQ ID NO: 533 - DNA, 29 bp, Homo sapiens
  misc_feature (1)...(29): n = A,T,C or G
cagagtgccacgcanagcacccccggcat

SEQ ID NO: 534 - DNA, 38 bp, Homo sapiens
  misc_feature (1)...(38): n = A,T,C or G
tttttggttccttccttattaanatggtatctttgtga

SEQ ID NO: 535 - DNA, 19 bp, Homo sapiens
  misc_feature (1)...(19): n = A,T,C or G
gcctcaaggnaagaatatt

SEQ ID NO: 536 - DNA, 29 bp, Homo sapiens
  misc_feature (1)...(29): n = A,T,C or G
ctccaaccatgccnccctctttctggggc

SEQ ID NO: 537 - DNA, 34 bp, Homo sapiens
  misc_feature (1)...(34): n = A,T,C or G
gagtcctagtaaattgacnaccaagtactaagac

SEQ ID NO: 538 - DNA, 33 bp, Homo sapiens
  misc_feature (1)...(33): n = A,T,C or G
cctagtaaattgactancaagtactaagaccaa

SEQ ID NO: 539 - DNA, 32 bp, Homo sapiens
  misc_feature (1)...(32): n = A,T,C or G
tgagggacatcacagntgtctccagaaaggta

SEQ ID NO: 540 - DNA, 29 bp, Homo sapiens
  misc_feature (1)...(29): n = A,T,C or G
agtctcggtctcanagtgcccatgctatt

SEQ ID NO: 541 - DNA, 28 bp, Homo sapiens
  misc_feature (1)...(28): n = A,T,C or G
taaagagaaagaancatttgtcctgatt

SEQ ID NO: 542 - DNA, 33 bp, Homo sapiens
  misc_feature (1)...(33): n = A,T,C or G
catgcttcctatggtctngccaaaaggactgaa

SEQ ID NO: 543 - DNA, 28 bp, Homo sapiens
  misc_feature (1)...(28): n = A,T,C or G
ggaatgtgctgaantgcatcatcagtgt

SEQ ID NO: 544 - DNA, 31 bp, Homo sapiens
  misc_feature (1)...(31): n = A,T,C or G
taagaggtagtatcangtacaaaagtattct

SEQ ID NO: 545 - DNA, 34 bp, Homo sapiens
  misc_feature (1)...(34): n = A,T,C or G
gatattcacagtatagtgnggaagaccaacatta

SEQ ID NO: 546 - DNA, 30 bp, Homo sapiens
  misc_feature (1)...(30): n = A,T,C or G
ttttctgttgttgttntttttttccatcac

SEQ ID NO: 547 - DNA, 27 bp, Homo sapiens
  misc_feature (1)...(27): n = A,T,C or G
catacttttagccanttagggtgtatt

SEQ ID NO: 548 - DNA, 26 bp, Homo sapiens
  misc_feature (1)...(26): n = A,T,C or G
tgtgaaaccttgggnaagttatttaa

SEQ ID NO: 549 - DNA, 29 bp, Homo sapiens
  misc_feature (1)...(29): n = A,T,C or G
taatcccagcaactcnggaggctgagaca

SEQ ID NO: 550 - DNA, 32 bp, Homo sapiens
  misc_feature (1)...(32): n = A,T,C or G
gaatctcttgaacctgngaggcagaggttgca

SEQ ID NO: 551 - DNA, 30 bp, Homo sapiens
  misc_feature (1)...(30): n = A,T,C or G
gtgttctcacatgtgncatgtggccaagga

SEQ ID NO: 552 - DNA, 27 bp, Homo sapiens
  misc_feature (1)...(27): n = A,T,C or G
agttaaaagctttanaattatacaaat

SEQ ID NO: 553 - DNA, 32 bp, Homo sapiens
  misc_feature (1)...(32): n = A,T,C or G
ttacctagtcaaccggntcacagatacattca

SEQ ID NO: 554 - DNA, 37 bp, Homo sapiens
  misc_feature (1)...(37): n = A,T,C or G
atttgaattacggagtcagatnttggctcttcttact

SEQ ID NO: 555 - DNA, 32 bp, Homo sapiens
  misc_feature (1)...(32): n = A,T,C or G
gaagggccaggcacangcttcttcctcagtgc

SEQ ID NO: 556 - DNA, 32 bp, Homo sapiens
  misc_feature (1)...(32): n = A,T,C or G
agcaaggcctctaacncttgctcctaaaaatc

SEQ ID NO: 557 - DNA, 32 bp, Homo sapiens
  misc_feature (1)...(32): n = A,T,C or G
tgggccaatgacccccnggtcctttttgtgac

SEQ ID NO: 558 - DNA, 26 bp, Homo sapiens
  misc_feature (1)...(26): n = A,T,C or G
cctgctctgctcnggttcccaccctg

SEQ ID NO: 559 - DNA, 30 bp, Homo sapiens
  misc_feature (1)...(30): n = A,T,C or G
accctgggccaatganccccgggtcctttt

SEQ ID NO: 560 - DNA, 31 bp, Homo sapiens
  misc_feature (1)...(31): n = A,T,C or G
gctcccactctactattnactcttccaacct

SEQ ID NO: 561 - DNA, 26 bp, Homo sapiens
  misc_feature (1)...(26): n = A,T,C or G
tggatctggctncgcctgcctaaaca

SEQ ID NO: 562 - DNA, 30 bp, Homo sapiens
  misc_feature (1)...(30): n = A,T,C or G
ctgcttctccgcactgntgggcagtgtggg

SEQ ID NO: 563 - DNA, 31 bp, Homo sapiens
  misc_feature (1)...(31): n = A,T,C or G
agtgctcattttgaganaggccccagagcat

SEQ ID NO: 564 - DNA, 29 bp, Homo sapiens
  misc_feature (1)...(29): n = A,T,C or G
gtgggtttaagattngggtcacgagtcta

SEQ ID NO: 565 - DNA, 23 bp, Homo sapiens
  misc_feature (1)...(23): n = A,T,C or G
tgccccctgtatngaagagaggc

SEQ ID NO: 566 - DNA, 24 bp, Homo sapiens
  misc_feature (1)...(24): n = A,T,C or G
ttttttttttnggctccctgaccc

SEQ ID NO: 567 - DNA, 23 bp, Homo sapiens
  misc_feature (1)...(23): n = A,T,C or G
ccaccagcctggntaatttttgt

SEQ ID NO: 568 - DNA, 22 bp, Homo sapiens
  misc_feature (1)...(22): n = A,T,C or G
gaggttcaagntccaggtctct

SEQ ID NO: 569 - DNA, 24 bp, Homo sapiens
  misc_feature (1)...(24): n = A,T,C or G
tgagggctctcncatcttctaaga

SEQ ID NO: 570 - DNA, 24 bp, Homo sapiens
  misc_feature (1)...(24): n = A,T,C or G
aggacaatgggnagggagtgggag

SEQ ID NO: 571 - DNA, 27 bp, Homo sapiens
  misc_feature (1)...(27): n = A,T,C or G
attacaggcacccnccaccacgcaggg

SEQ ID NO: 572 - DNA, 27 bp, Homo sapiens
  misc_feature (1)...(27): n = A,T,C or G
atttttagcgganacgaggtttcacca

SEQ ID NO: 573 - DNA, 22 bp, Homo sapiens
  misc_feature (1)...(22): n = A,T,C or G
tgtctgtccanaggctggacag

SEQ ID NO: 574 - DNA, 20 bp, Homo sapiens
  misc_feature (1)...(20): n = A,T,C or G
ttttttttttngagacggag

SEQ ID NO: 575 - DNA, 27 bp, Homo sapiens
  misc_feature (1)...(27): n = A,T,C or G
ccaccacgccctgccantatttattta

SEQ ID NO: 576 - DNA, 25 bp, Homo sapiens
  misc_feature (1)...(25): n = A,T,C or G
ctagatgcagtgntcagcaggccag

SEQ ID NO: 577 - DNA, 21 bp, Homo sapiens
  misc_feature (1)...(21): n = A,T,C or G
aactgaangttccaatttcct

SEQ ID NO: 578 - DNA, 28 bp, Homo sapiens
  misc_feature (1)...(28): n = A,T,C or G
ggctcagcaccaacanccagcagggctt

SEQ ID NO: 579 - DNA, 26 bp, Homo sapiens
  misc_feature (1)...(26): n = A,T,C or G
ttcttgctgctgcantggggccttca

SEQ ID NO: 580 - DNA, 27 bp, Homo sapiens
  misc_feature (1)...(27): n = A,T,C or G
acaccctaggctcacngagaggcctcc

SEQ ID NO: 581 - DNA, 31 bp, Homo sapiens
  misc_feature (1)...(31): n = A,T,C or G
tatcaatgagggctantcactggctacttac

SEQ ID NO: 582 - DNA, 28 bp, Homo sapiens
  misc_feature (1)...(28): n = A,T,C or G
taatcccagctttgnaggcagaagcagg

SEQ ID NO: 583 - DNA, 28 bp, Homo sapiens
  misc_feature (1)...(28): n = A,T,C or G
aaacacaaaaattngctgggcgtcgtgg

SEQ ID NO: 584 - DNA, 26 bp, Homo sapiens
  misc_feature (1)...(26): n = A,T,C or G
cagctactcggagnctgaggcaggag

SEQ ID NO: 585 - DNA, 28 bp, Homo sapiens
  misc_feature (1)...(28): n = A,T,C or G
aggcgaagattgcantgagccaagaacg

SEQ ID NO: 586 - DNA, 33 bp, Homo sapiens
  misc_feature (1)...(33): n = A,T,C or G
tgacagagggagactctgtctctcctnaaaaaa

SEQ ID NO: 587 - DNA, 29 bp, Homo sapiens
  misc_feature (1)...(29): n = A,T,C or G
cccaactagagtaantcctggacacacag

SEQ ID NO: 588 - DNA, 27 bp, Homo sapiens
  misc_feature (1)...(27): n = A,T,C or G
tggccatcaggangggaggccagactg

SEQ ID NO: 589 - DNA, 25 bp, Homo sapiens
  misc_feature (1)...(25): n = A,T,C or G
ccggctccagcccnagcgccgagaa

SEQ ID NO: 590 - DNA, 27 bp, Homo sapiens
  misc_feature (1)...(27): n = A,T,C or G
agcgcggcctggggtcngggaacgcgg

SEQ ID NO: 591 - DNA, 25 bp, Homo sapiens
  misc_feature (1)...(25): n = A,T,C or G
ttctagtagccntattaataaaatt

SEQ ID NO: 592 - DNA, 26 bp, Homo sapiens
  misc_feature (1)...(26): n = A,T,C or G
gaggctgggagctntgacttttcatt

SEQ ID NO: 593 - DNA, 24 bp, Homo sapiens
  misc_feature (1)...(24): n = A,T,C or G
tcagaagctaactggnaaaaaaaa

SEQ ID NO: 594 - DNA, 34 bp, Homo sapiens
  misc_feature (1)...(34): n = A,T,C or G
atcatagtcaccgcagncctgaactcctaagctt

SEQ ID NO: 595 - DNA, 20 bp, Homo sapiens
  misc_feature (1)...(20): n = A,T,C or G
ttctcaggatttgnaaaaaa

SEQ ID NO: 596 - DNA, 27 bp, Homo sapiens
  misc_feature (1)...(27): n = A,T,C or G
tgaaattaactttantggtatatttaa

SEQ ID NO: 597 - DNA, 25 bp, Homo sapiens
  misc_feature (1)...(25): n = A,T,C or G
atataatgtgttgngtaaagaatat

SEQ ID NO: 598 - DNA, 27 bp, Homo sapiens
  misc_feature (1)...(27): n = A,T,C or G
cagcagatttttaanaaggaaatctaa

SEQ ID NO: 599 - DNA, 27 bp, Homo sapiens
  misc_feature (1)...(27): n = A,T,C or G
ctattcttacttcntgaagatggatgg

SEQ ID NO: 600 - DNA, 13 bp, Homo sapiens
  misc_feature (1)...(13): n = A,T,C or G
tgcantttttttt

SEQ ID NO: 601 - DNA, 13 bp, Homo sapiens
  misc_feature (1)...(13): n = A,T,C or G
gctantttttttg

SEQ ID NO: 602 - DNA, 21 bp, Homo sapiens
  misc_feature (1)...(21): n = A,T,C or G
tcaaacaatangttaaattaa

SEQ ID NO: 603 - DNA, 21 bp, Homo sapiens
  misc_feature (1)...(21): n = A,T,C or G
ggctgaggagggnggatcacc

SEQ ID NO: 604 - DNA, 20 bp, Homo sapiens
  misc_feature (1)...(20): n = A,T,C or G
aagactccgtctcnaaaaaa

SEQ ID NO: 605 - DNA, 18 bp, Homo sapiens
  misc_feature (1)...(18): n = A,T,C or G
ttcagagcntctgtccag

SEQ ID NO: 606 - DNA, 28 bp, Homo sapiens
  misc_feature (1)...(28): n = A,T,C or G
ttcaagtgattctnctgtctcagcctcc

SEQ ID NO: 607 - DNA, 32 bp, Homo sapiens
  misc_feature (1)...(32): n = A,T,C or G
taatagctgtttttttntgccaaaatcactgt

SEQ ID NO: 608 - DNA, 19 bp, Homo sapiens
  misc_feature (1)...(19): n = A,T,C or G
ccccacaattnggcttcaa

SEQ ID NO: 609 - DNA, 18 bp, Homo sapiens
  misc_feature (1)...(18): n = A,T,C or G
gtagtagaaangtaaatt

SEQ ID NO: 610 - DNA, 30 bp, Homo sapiens
  misc_feature (1)...(30): n = A,T,C or G
tatgtacaagtatctntttgagtacttgct

SEQ ID NO: 611 - DNA, 32 bp, Homo sapiens
  misc_feature (1)...(32): n = A,T,C or G
ttttaaaaaaaaaaaanttttaaggcatagga

SEQ ID NO: 612 - DNA, 29 bp, Homo sapiens
  misc_feature (1)...(29): n = A,T,C or G
cttcttggaaggctgnggcaggaagatgc

SEQ ID NO: 613 - DNA, 35 bp, Homo sapiens
  misc_feature (1)...(35): n = A,T,C or G
taccaaaaatacaaaaaattagccnggcgttgtgg

SEQ ID NO: 614 - DNA, 35 bp, Homo sapiens
  misc_feature (1)...(35): n = A,T,C or G
ttagccgggcgttgtggngggcacctgtagtaccc

SEQ ID NO: 615 - DNA, 40 bp, Homo sapiens
  misc_feature (1)...(40): n = A,T,C or G
ttgtgaaccccggaggcggangttgcaatgagtggagatt

SEQ ID NO: 616 - DNA, 26 bp, Homo sapiens
  misc_feature (1)...(26): n = A,T,C or G
ccccttatccacagnttttttttttt

SEQ ID NO: 617 - DNA, 33 bp, Homo sapiens
  misc_feature (1)...(33): n = A,T,C or G
tctccatgtcaccgcantcacatttgtgtgtgg

SEQ ID NO: 618 - DNA, 31 bp, Homo sapiens
  misc_feature (1)...(31): n = A,T,C or G
tcattagcctggcttncattctcttctgaac

SEQ ID NO: 619 - DNA, 25 bp, Homo sapiens
  misc_feature (1)...(25): n = A,T,C or G
atactactatggncctttgcttccg

SEQ ID NO: 620 - DNA, 27 bp, Homo sapiens
  misc_feature (1)...(27): n = A,T,C or G
cactactcatcttcntgagcacaaaag

SEQ ID NO: 621 - DNA, 30 bp, Homo sapiens
  misc_feature (1)...(30): n = A,T,C or G
aaatgagtagccttcntttgagagacagag

SEQ ID NO: 622 - DNA, 29 bp, Homo sapiens
  misc_feature (1)...(29): n = A,T,C or G
gatcatctcaaggttcncaaaatcaagct

SEQ ID NO: 623 - DNA, 26 bp, Homo sapiens
  misc_feature (1)...(26): n = A,T,C or G
gatgcaagaanttttttttttttttt

SEQ ID NO: 624 - DNA, 32 bp, Homo sapiens
  misc_feature (1)...(32): n = A,T,C or G
acaggcatccaccaccntgccctggtaatttt

SEQ ID NO: 625 - DNA, 30 bp, Homo sapiens
  misc_feature (1)...(30): n = A,T,C or G
catgtgatctgccngcctcagccttccaaa

SEQ ID NO: 626 - DNA, 22 bp, Homo sapiens
  misc_feature (1)...(22): n = A,T,C or G
ccaatgcgcctggccntttttt

SEQ ID NO: 627 - DNA, 32 bp, Homo sapiens
  misc_feature (1)...(32): n = A,T,C or G
cctctgcctcccaggttnaagcagttctcctg

SEQ ID NO: 628 - DNA, 27 bp, Homo sapiens
  misc_feature (1)...(27): n = A,T,C or G
gccttccaaagtgcnaggattacaggt

SEQ ID NO: 629 - DNA, 27 bp, Homo sapiens
  misc_feature (1)...(27): n = A,T,C or G
cattcttgcattantataaagaaatac

SEQ ID NO: 630 - DNA, 28 bp, Homo sapiens
  misc_feature (1)...(28): n = A,T,C or G
aaattaatttttttcttccntttttttt

SEQ ID NO: 631 - DNA, 28 bp, Homo sapiens
  misc_feature (1)...(28): n = A,T,C or G
taatttttttaaatnaatttttttcttc

SEQ ID NO: 632 - DNA, 21 bp, Homo sapiens
  misc_feature (1)...(21): n = A,T,C or G
cctggctctctnttagttatt

SEQ ID NO: 633 - DNA, 27 bp, Homo sapiens
  misc_feature (1)...(27): n = A,T,C or G
gccttcactttccanatcaccatcagc

SEQ ID NO: 634 - DNA, 31 bp, Homo sapiens
  misc_feature (1)...(31): n = A,T,C or G
tgccaagtactattntaacttctgagaatac

SEQ ID NO: 635 - DNA, 26 bp, Homo sapiens
  misc_feature (1)...(26): n = A,T,C or G
gaaaaatgaagcnggagaaaaatgaa

SEQ ID NO: 636 - DNA, 21 bp, Homo sapiens
  misc_feature (1)...(21): n = A,T,C or G
tgtctacatgcnagacaatca

SEQ ID NO: 637 - DNA, 24 bp, Homo sapiens
  misc_feature (1)...(24): n = A,T,C or G
ctttgggaggcngaggcaggcaga

SEQ ID NO: 638 - DNA, 39 bp, Homo sapiens
  misc_feature (1)...(39): n = A,T,C or G
gtgaaaccccgttctctactaaaaaatacnaaaaaaaaa

SEQ ID NO: 639 - DNA, 30 bp, Homo sapiens
  misc_feature (1)...(30): n = A,T,C or G
acagagcgagactccgtctcnaaaaaaaaa

SEQ ID NO: 640 - DNA, 30 bp, Homo sapiens
  misc_feature (1)...(30): n = A,T,C or G
ttgtaaggacttgggntttcaaaaaatctg

SEQ ID NO: 641 - DNA, 24 bp, Homo sapiens
  misc_feature (1)...(24): n = A,T,C or G
tatagaccattgnaaggacttggg

SEQ ID NO: 642 - DNA, 22 bp, Homo sapiens
  misc_feature (1)...(22): n = A,T,C or G
atggcaaaagantttattgaca

SEQ ID NO: 643 - DNA, 29 bp, Homo sapiens
  misc_feature (1)...(29): n = A,T,C or G
ggatgtggagtacnagaggaagagcagcc

SEQ ID NO: 644 - DNA, 34 bp, Homo sapiens
  misc_feature (1)...(34): n = A,T,C or G
cccaagtagctgggactncaggtgtgtgccacca

SEQ ID NO: 645 - DNA, 35 bp, Homo sapiens
  misc_feature (1)...(35): n = A,T,C or G
ctgtaatcctagctacttnggaggctgaggcatga

SEQ ID NO: 646 - DNA, 23 bp, Homo sapiens
  misc_feature (1)...(23): n = A,T,C or G
tagcaagaagtnggagggaggtt

SEQ ID NO: 647 - DNA, 19 bp, Homo sapiens
  misc_feature (1)...(19): n = A,T,C or G
gtctcatgtnatccccacc

SEQ ID NO: 648 - DNA, 24 bp, Homo sapiens
  misc_feature (1)...(24): n = A,T,C or G
tctatttatcttnaatttcctatt

SEQ ID NO: 649 - DNA, 29 bp, Homo sapiens
  misc_feature (1)...(29): n = A,T,C or G
atggaattgttatcntccctctttacaga

SEQ ID NO: 650 - DNA, 25 bp, Homo sapiens
  misc_feature (1)...(25): n = A,T,C or G
tgtgtgtgtngtgtgtgtgtttgtg

SEQ ID NO: 651 - DNA, 21 bp, Homo sapiens
  misc_feature (1)...(21): n = A,T,C or G
cctggaaaaangggacactcc

SEQ ID NO: 652 - DNA, 21 bp, Homo sapiens
  misc_feature (1)...(21): n = A,T,C or G
ttagcaaatggnacaccagga

SEQ ID NO: 653 - DNA, 23 bp, Homo sapiens
  misc_feature (1)...(23): n = A,T,C or G
tcgacagatccnatgtccatgga

SEQ ID NO: 654 - DNA, 24 bp, Homo sapiens
  misc_feature (1)...(24): n = A,T,C or G
atttgctgttcngcaatatttgct

SEQ ID NO: 655 - DNA, 27 bp, Homo sapiens
  misc_feature (1)...(27): n = A,T,C or G
tgcagctgagggncctcactggtagaa

SEQ ID NO: 656 - DNA, 22 bp, Homo sapiens
  misc_feature (1)...(22): n = A,T,C or G
taactcaagaanattagagaaa

SEQ ID NO: 657 - DNA, 18 bp, Homo sapiens
  misc_feature (1)...(18): n = A,T,C or G
aaaacactcntcaggata

SEQ ID NO: 658 - DNA, 27 bp, Homo sapiens
  misc_feature (1)...(27): n = A,T,C or G
ttcttaaagaaaanaattttcaaccca

SEQ ID NO: 659 - DNA, 32 bp, Homo sapiens
  misc_feature (1)...(32): n = A,T,C or G
gattttgtcaccacnaggcctgccctaaaaga

SEQ ID NO: 660 - DNA, 20 bp, Homo sapiens
  misc_feature (1)...(20): n = A,T,C or G
ccctacaagccngaagagag

SEQ ID NO: 661 - DNA, 28 bp, Homo sapiens
  misc_feature (1)...(28): n = A,T,C or G
tttaaatgtaaatggnctaaatgctcca

SEQ ID NO: 662 - DNA, 24 bp, Homo sapiens
  misc_feature (1)...(24): n = A,T,C or G
caaagacacaacntgccagaatct

SEQ ID NO: 663 - DNA, 22 bp, Homo sapiens
  misc_feature (1)...(22): n = A,T,C or G
ccaataacaggntctgaaattg

SEQ ID NO: 664 - DNA, 24 bp, Homo sapiens
  misc_feature (1)...(24): n = A,T,C or G
ttttgtatctacnggcaaaatata

SEQ ID NO: 665 - DNA, 26 bp, Homo sapiens
  misc_feature (1)...(26): n = A,T,C or G
aatatctcattagtnataatgagccc

SEQ ID NO: 666 - DNA, 20 bp, Homo sapiens
  misc_feature (1)...(20): n = A,T,C or G
cttggatgttngaatggcat

SEQ ID NO: 667 - DNA, 28 bp, Homo sapiens
  misc_feature (1)...(28): n = A,T,C or G
ggttgagtgtgacantacagggtaaaaa

SEQ ID NO: 668 - DNA, 35 bp, Homo sapiens
  misc_feature (1)...(35): n = A,T,C or G
tttctggataggaatnctgcatataatcatttggt

SEQ ID NO: 669 - DNA, 33 bp, Homo sapiens
  misc_feature (1)...(33): n = A,T,C or G
tttgtatcctttgtaagaaacngctagtggcca

SEQ ID NO: 670 - DNA, 35 bp, Homo sapiens
  misc_feature (1)...(35): n = A,T,C or G
taggtattgtcaaaattgnactgcattataggaca

SEQ ID NO: 671 - DNA, 24 bp, Homo sapiens
  misc_feature (1)...(24): n = A,T,C or G
gatgtgttttttttntggagacgg

SEQ ID NO: 672 - DNA, 30 bp, Homo sapiens
  misc_feature (1)...(30): n = A,T,C or G
aatttttgtattttntagtagagatggggt

SEQ ID NO: 673 - DNA, 32 bp, Homo sapiens
  misc_feature (1)...(32): n = A,T,C or G
gcccagtctggagtgcngtggcatgatgttgg

SEQ ID NO: 674 - DNA, 29 bp, Homo sapiens
  misc_feature (1)...(29): n = A,T,C or G
ttggctcactgcaanctccacctcccggg

SEQ ID NO: 675 - DNA, 35 bp, Homo sapiens
  misc_feature (1)...(35): n = A,T,C or G
caacctctgcctcctgggtngcagttctcctgcct

SEQ ID NO: 676 - DNA, 16 bp, Homo sapiens
  misc_feature (1)...(16): n = A,T,C or G
aaaaaaancaactaag

SEQ ID NO: 677 - DNA, 19 bp, Homo sapiens
  misc_feature (1)...(19): n = A,T,C or G
taaccaggntgtttcaggg

SEQ ID NO: 678 - DNA, 20 bp, Homo sapiens
  misc_feature (1)...(20): n = A,T,C or G
aaatgggggntgggaggaca

SEQ ID NO: 679 - DNA, 19 bp, Homo sapiens
  misc_feature (1)...(19): n = A,T,C or G
cagattaaancagtaaatt

SEQ ID NO: 680 - DNA, 18 bp, Homo sapiens
  misc_feature (1)...(18): n = A,T,C or G
agttttggcnatgatagg

SEQ ID NO: 681 - DNA, 20 bp, Homo sapiens
  misc_feature (1)...(20): n = A,T,C or G
atgttttcangtgtgtgtgt

SEQ ID NO: 682 - DNA, 21 bp, Homo sapiens
  misc_feature (1)...(21): n = A,T,C or G
cttccattgcnaagagtttgc

SEQ ID NO: 683 - DNA, 21 bp, Homo sapiens
  misc_feature (1)...(21): n = A,T,C or G
taatttcttangcctgtcttt

SEQ ID NO: 684 - DNA, 17 bp, Homo sapiens
  misc_feature (1)...(17): n = A,T,C or G
aacatgccnctgaaaca

SEQ ID NO: 685 - DNA, 19 bp, Homo sapiens
  misc_feature (1)...(19): n = A,T,C or G
cccaggcttnttaggatga

SEQ ID NO: 686 - DNA, 18 bp, Homo sapiens
  misc_feature (1)...(18): n = A,T,C or G
aaaccctgntcctgataa

SEQ ID NO: 687 - DNA, 18 bp, Homo sapiens
  misc_feature (1)...(18): n = A,T,C or G
tgaaataancccccagtc

SEQ ID NO: 688 - DNA, 19 bp, Homo sapiens
  misc_feature (1)...(19): n = A,T,C or G
ttgtgaaaangtcaaatag

SEQ ID NO: 689 - DNA, 18 bp, Homo sapiens
  misc_feature (1)...(18): n = A,T,C or G
ttttagaantgatacttt

SEQ ID NO: 690 - DNA, 28 bp, Homo sapiens
  misc_feature (1)...(28): n = A,T,C or G
ttaagaaatatgtntttctattactatc

SEQ ID NO: 691 - DNA, 17 bp, Homo sapiens
  misc_feature (1)...(17): n = A,T,C or G
ctgggcagngttcgcaa

SEQ ID NO: 692 - DNA, 18 bp, Homo sapiens
  misc_feature (1)...(18): n = A,T,C or G
atattgaacnacatagat

SEQ ID NO: 693 - DNA, 19 bp, Homo sapiens
  misc_feature (1)...(19): n = A,T,C or G
tgaaaccccntctctactt

SEQ ID NO: 694 - DNA, 30 bp, Homo sapiens
  misc_feature (1)...(30): n = A,T,C or G
gagtggaactctcacngcccagatttcctc

SEQ ID NO: 695 - DNA, 30 bp, Homo sapiens
  misc_feature (1)...(30): n = A,T,C or G
attttctctctctcttnttttctctttcct

SEQ ID NO: 696 - DNA, 19 bp, Homo sapiens
  misc_feature (1)...(19): n = A,T,C or G
aggagtagnttagatagaa

SEQ ID NO: 697 - DNA, 17 bp, Homo sapiens
  misc_feature (1)...(17): n = A,T,C or G
agtagcacnactaccca

SEQ ID NO: 698 - DNA, 30 bp, Homo sapiens
  misc_feature (1)...(30): n = A,T,C or G
cccatgaaggcaccaantcaactgcccagt

SEQ ID NO: 699 - DNA, 29 bp, Homo sapiens
  misc_feature (1)...(29): n = A,T,C or G
ccagttctgacgatcatcntgtgtgtgtg

SEQ ID NO: 700 - DNA, 19 bp, Homo sapiens
  misc_feature (1)...(19): n = A,T,C or G
cagttctgacnatcatcgt

SEQ ID NO: 701 - DNA, 18 bp, Homo sapiens
  misc_feature (1)...(18): n = A,T,C or G
cgtaagccantgcgccca

SEQ ID NO: 702 - DNA, 25 bp, Homo sapiens
  misc_feature (1)...(25): n = A,T,C or G
aaatactgtaccctgtgacnttttt

SEQ ID NO: 703 - DNA, 18 bp, Homo sapiens
  misc_feature (1)...(18): n = A,T,C or G
cacttattanttaccata

SEQ ID NO: 704 - DNA, 18 bp, Homo sapiens
  misc_feature (1)...(18): n = A,T,C or G
tgcatgcaantctcactt

SEQ ID NO: 705 - DNA, 19 bp, Homo sapiens
  misc_feature (1)...(19): n = A,T,C or G
atgcaactcncacttcacc

SEQ ID NO: 706 - DNA, 24 bp, Homo sapiens
  misc_feature (1)...(24): n = A,T,C or G
cacatttatatatgcntgtgtgtg

SEQ ID NO: 707 - DNA, 30 bp, Homo sapiens
  misc_feature (1)...(30): n = A,T,C or G
ctgctggtacagcntgttgttcatttttgc

SEQ ID NO: 708 - DNA, 29 bp, Homo sapiens
  misc_feature (1)...(29): n = A,T,C or G
gggcactgacacccncctgtgtggggccc

SEQ ID NO: 709 - DNA, 30 bp, Homo sapiens
  misc_feature (1)...(30): n = A,T,C or G
gggcacctgtgttcntgatcgtttccttta

SEQ ID NO: 710 - DNA, 38 bp, Homo sapiens
  misc_feature (1)...(38): n = A,T,C or G
ttgtgttagaaaattttgcccnattgtaggctaatgta

SEQ ID NO: 711 - DNA, 28 bp, Homo sapiens
  misc_feature (1)...(28): n = A,T,C or G
cagctttattgaagangcaatgttacag

SEQ ID NO: 712 - DNA, 32 bp, Homo sapiens
  misc_feature (1)...(32): n = A,T,C or G
gtcttctgccctggctntgttttagctggtcc

SEQ ID NO: 713 - DNA, 29 bp, Homo sapiens
  misc_feature (1)...(29): n = A,T,C or G
cttacttagcctaganaacaaattataag

SEQ ID NO: 714 - DNA, 27 bp, Homo sapiens
  misc_feature (1)...(27): n = A,T,C or G
tataggaactacnataatgttaggtca

SEQ ID NO: 715 - DNA, 28 bp, Homo sapiens
  misc_feature (1)...(28): n = A,T,C or G
gctggagagcttgnctcatactgagcag

SEQ ID NO: 716 - DNA, 29 bp, Homo sapiens
  misc_feature (1)...(29): n = A,T,C or G
tctccttagggcanagtgagcaggctccc

SEQ ID NO: 717 - DNA, 28 bp, Homo sapiens
  misc_feature (1)...(28): n = A,T,C or G
attctctctctctctntctctctgatag

SEQ ID NO: 718 - DNA, 30 bp, Homo sapiens
  misc_feature (1)...(30): n = A,T,C or G
ggcatgatcatatagcncactgtaatcttg

SEQ ID NO: 719 - DNA, 34 bp, Homo sapiens
  misc_feature (1)...(34): n = A,T,C or G
gggattacaggtgtgaancaccatacctggctaa

SEQ ID NO: 720 - DNA, 19 bp, Homo sapiens
  misc_feature (1)...(19): n = A,T,C or G
ctggaggtncacagacagg

SEQ ID NO: 721 - DNA, 17 bp, Homo sapiens
  misc_feature (1)...(17): n = A,T,C or G
agtccaagnacaaagct

SEQ ID NO: 722 - DNA, 17 bp, Homo sapiens
  misc_feature (1)...(17): n = A,T,C or G
attcatgcntgcctttt

SEQ ID NO: 723 - DNA, 17 bp, Homo sapiens
  misc_feature (1)...(17): n = A,T,C or G
actagggangccaaggc

SEQ ID NO: 724 - DNA, 19 bp, Homo sapiens
  misc_feature (1)...(19): n = A,T,C or G
gtaatcccanctattcggg

SEQ ID NO: 725 - DNA, 19 bp, Homo sapiens
  misc_feature (1)...(19): n = A,T,C or G
gtcaggggantgatggaaa

SEQ ID NO: 726 - DNA, 16 bp, Homo sapiens
  misc_feature (1)...(16): n = A,T,C or G
aaatacantaaaataa

SEQ ID NO: 727 - DNA, 17 bp, Homo sapiens
  misc_feature (1)...(17): n = A,T,C or G
gggagaaccntcaccag

SEQ ID NO: 728 - DNA, 24 bp, Homo sapiens
  misc_feature (1)...(24): n = A,T,C or G
aaatacagaaanactttttgtgtt

SEQ ID NO: 729 - DNA, 22 bp, Homo sapiens
  misc_feature (1)...(22): n = A,T,C or G
gggccagaggntggaagcgaag

SEQ ID NO: 730 - DNA, 19 bp, Homo sapiens
  misc_feature (1)...(19): n = A,T,C or G
cccgctcacanaggggagg

SEQ ID NO: 731 - DNA, 22 bp, Homo sapiens
  misc_feature (1)...(22): n = A,T,C or G
acctgagaanccaacacaacga

SEQ ID NO: 732 - DNA, 16 bp, Homo sapiens
  misc_feature (1)...(16): n = A,T,C or G
tcgtcacanggaagat

SEQ ID NO: 733 - DNA, 20 bp, Homo sapiens
  misc_feature (1)...(20): n = A,T,C or G
caccctaganatgatgggaa

SEQ ID NO: 734 - DNA, 33 bp, Homo sapiens
  misc_feature (1)...(33): n = A,T,C or G
ataggcccagtgatggngggctggcactgaact

SEQ ID NO: 735 - DNA, 34 bp, Homo sapiens
  misc_feature (1)...(34): n = A,T,C or G
caggcatcaatgcaganttagtgttttttcaggg

SEQ ID NO: 736 - DNA, 35 bp, Homo sapiens
  misc_feature (1)...(35): n = A,T,C or G
ctctggcagacttttttcnctgtcacatcctccca

SEQ ID NO: 737 - DNA, 38 bp, Homo sapiens
  misc_feature (1)...(38): n = A,T,C or G
aagcatggagcagtgtacncaaggaccttgtggaaata

SEQ ID NO: 738 - DNA, 33 bp, Homo sapiens
  misc_feature (1)...(33): n = A,T,C or G
tgtggccccagtgcctngcccagggtccaagcc

SEQ ID NO: 739 - DNA, 37 bp, Homo sapiens
  misc_feature (1)...(37): n = A,T,C or G
cagactctcctcccctnggccaggatattgcctttgt

SEQ ID NO: 740 - DNA, 33 bp, Homo sapiens
  misc_feature (1)...(33): n = A,T,C or G
ttgactggcctgtgccnggactggggagagtaa

SEQ ID NO: 741 - DNA, 33 bp, Homo sapiens
  misc_feature (1)...(33): n = A,T,C or G
gtgatgctcctactcngctcgcattacatagca

SEQ ID NO: 742 - DNA, 32 bp, Homo sapiens
  misc_feature (1)...(32): n = A,T,C or G
tttatatcacacctnattctgcagcagacaga

SEQ ID NO: 743 - DNA, 36 bp, Homo sapiens
  misc_feature (1)...(36): n = A,T,C or G
gtccacgggcctgcctgnttgccagacggggctcca

SEQ ID NO: 744 - DNA, 33 bp, Homo sapiens
  misc_feature (1)...(33): n = A,T,C or G
ttctgaatactgagatcngaaagaagtgtctcc

SEQ ID NO: 745 - DNA, 34 bp, Homo sapiens
  misc_feature (1)...(34): n = A,T,C or G
tttagagatagaaaggaanggaaggctgttagat

SEQ ID NO: 746 - DNA, 31 bp, Homo sapiens
  misc_feature (1)...(31): n = A,T,C or G
ggggtcctttagaaanggcttttcttaggaa

SEQ ID NO: 747 - DNA, 34 bp, Homo sapiens
  misc_feature (1)...(34): n = A,T,C or G
gttaacagtgacatggngggcccagtgggagaca

SEQ ID NO: 748 - DNA, 24 bp, Homo sapiens
  misc_feature (1)...(24): n = A,T,C or G
cctagtgaattggtnaaaaaaaaa

SEQ ID NO: 749 - DNA, 32 bp, Homo sapiens
  misc_feature (1)...(32): n = A,T,C or G
cccctcctcaccatnctccagcagaaggacag

SEQ ID NO: 750 - DNA, 27 bp, Homo sapiens
  misc_feature (1)...(27): n = A,T,C or G
aaaaaaaaaaaaanttgcttaatcatt

SEQ ID NO: 751 - DNA, 34 bp, Homo sapiens
  misc_feature (1)...(34): n = A,T,C or G
cttcaaaaagatgacantaatacctgctcctagg

SEQ ID NO: 752 - DNA, 34 bp, Homo sapiens
  misc_feature (1)...(34): n = A,T,C or G
aaatatcagtggagcntctgacacattacaggcc

SEQ ID NO: 753 - DNA, 40 bp, Homo sapiens
  misc_feature (1)...(40): n = A,T,C or G
ttagcagtcactcctcattcnctacttcctctagcccctg

SEQ ID NO: 754 - DNA, 36 bp, Homo sapiens
  misc_feature (1)...(36): n = A,T,C or G
tatatatatatatatntatttcacggtttgggtcta

SEQ ID NO: 755 - DNA, 22 bp, Homo sapiens
  misc_feature (1)...(22): n = A,T,C or G
caacaacntatatatatatata

SEQ ID NO: 756 - DNA, 31 bp, Homo sapiens
  misc_feature (1)...(31): n = A,T,C or G
tccacttgttaaggncttctggaatttcttt

SEQ ID NO: 757 - DNA, 32 bp, Homo sapiens
  misc_feature (1)...(32): n = A,T,C or G
tttcaattattgtatanttttactccagaagt

SEQ ID NO: 758 - DNA, 35 bp, Homo sapiens
  misc_feature (1)...(35): n = A,T,C or G
caatattgtcatcanacttttaaaagcatgacttc

SEQ ID NO: 759 - DNA, 35 bp, Homo sapiens
  misc_feature (1)...(35): n = A,T,C or G
ttgaacatatttataanggctgccttatgccttaa

SEQ ID NO: 760 - DNA, 33 bp, Homo sapiens
  misc_feature (1)...(33): n = A,T,C or G
cttgccaaggtatagtngactttcttgaataaa

SEQ ID NO: 761 - DNA, 40 bp, Homo sapiens
  misc_feature (1)...(40): n = A,T,C or G
tttatccatttttaaatcangttgtctttttattgctgag

SEQ ID NO: 762 - DNA, 37 bp, Homo sapiens
  misc_feature (1)...(37): n = A,T,C or G
tctggaagttgccgcctgnacctgccctccagtcttg

SEQ ID NO: 763 - DNA, 20 bp, Homo sapiens
  misc_feature (1)...(20): n = A,T,C or G
gaagttcccngttagcaggg

SEQ ID NO: 764 - DNA, 36 bp, Homo sapiens
  misc_feature (1)...(36): n = A,T,C or G
caaacaaacaaacaaacaaanaactagccgggcatg

SEQ ID NO: 765 - DNA, 33 bp, Homo sapiens
  misc_feature (1)...(33): n = A,T,C or G
taaaataaaataaaanaaaacgaaaaataattt

SEQ ID NO: 766 - DNA, 26 bp, Homo sapiens
  misc_feature (1)...(26): n = A,T,C or G
gggcagggagtggncaagcactagag

SEQ ID NO: 767 - DNA, 30 bp, Homo sapiens
  misc_feature (1)...(30): n = A,T,C or G
cctccgaataaagtcanctcctcagtatac

SEQ ID NO: 768 - DNA, 31 bp, Homo sapiens
  misc_feature (1)...(31): n = A,T,C or G
gagtcctattctttctnggggtgcacacccg

SEQ ID NO: 769 - DNA, 26 bp, Homo sapiens
  misc_feature (1)...(26): n = A,T,C or G
gaaacgacccagnaatgcgcctcgcg

SEQ ID NO: 770 - DNA, 33 bp, Homo sapiens
  misc_feature (1)...(33): n = A,T,C or G
gctcgggccgcgtngccccgggcccagacccca

SEQ ID NO: 771 - DNA, 20 bp, Homo sapiens
  misc_feature (1)...(20): n = A,T,C or G
cggcaggctgncagagcttt

SEQ ID NO: 772 - DNA, 24 bp, Homo sapiens
  misc_feature (1)...(24): n = A,T,C or G
ttgagatggttnttggcgatgacc

SEQ ID NO: 773 - DNA, 16 bp, Homo sapiens
  misc_feature (1)...(16): n = A,T,C or G
ggaacaatctcntttt

SEQ ID NO: 774 - DNA, 18 bp, Homo sapiens
  misc_feature (1)...(18): n = A,T,C or G
ttccagattngcacataa

SEQ ID NO: 775 - DNA, 19 bp, Homo sapiens
  misc_feature (1)...(19): n = A,T,C or G
gtatgtaaanctctatctg

SEQ ID NO: 776 - DNA, 20 bp, Homo sapiens
  misc_feature (1)...(20): n = A,T,C or G
tgataagtctgcnttttttt

SEQ ID NO: 777 - DNA, 19 bp, Homo sapiens
  misc_feature (1)...(19): n = A,T,C or G
gcaaacaccnccacaccca

SEQ ID NO: 778 - DNA, 24 bp, Homo sapiens
  misc_feature (1)...(24): n = A,T,C or G
ctagaacaaaaangtaagaaaaaa

SEQ ID NO: 779 - DNA, 18 bp, Homo sapiens
  misc_feature (1)...(18): n = A,T,C or G
agttgctanaacatctgt

SEQ ID NO: 780 - DNA, 22 bp, Homo sapiens
  misc_feature (1)...(22): n = A,T,C or G
actccgtctcnaaaaaaaaaaa

SEQ ID NO: 781 - DNA, 20 bp, Homo sapiens
  misc_feature (1)...(20): n = A,T,C or G
aaattgcttnacccggaggc

SEQ ID NO: 782 - DNA, 19 bp, Homo sapiens
  misc_feature (1)...(19): n = A,T,C or G
cctggagaanagctgagaa

SEQ ID NO: 783 - DNA, 20 bp, Homo sapiens
  misc_feature (1)...(20): n = A,T,C or G
aggtggcacngatctctaaa

SEQ ID NO: 784 - DNA, 18 bp, Homo sapiens
  misc_feature (1)...(18): n = A,T,C or G
aaagctgtccngctgcca

SEQ ID NO: 785 - DNA, 34 bp, Homo sapiens
  misc_feature (1)...(34): n = A,T,C or G
agaaatcatgagagcagnaaagggagaaagggta

SEQ ID NO: 786 - DNA, 32 bp, Homo sapiens
  misc_feature (1)...(32): n = A,T,C or G
acaacaacaacaanaaaaaagagctcaaatgg

SEQ ID NO: 787 - DNA, 30 bp, Homo sapiens
  misc_feature (1)...(30): n = A,T,C or G
gtcttttgtaaaaacnacaaatttattata

SEQ ID NO: 788 - DNA, 32 bp, Homo sapiens
  misc_feature (1)...(32): n = A,T,C or G
ggcaggcggatcangaggtcaagagatccaga

SEQ ID NO: 789 - DNA, 16 bp, Homo sapiens
  misc_feature (1)...(16): n = A,T,C or G
aaggggcngacatggc

SEQ ID NO: 790 - DNA, 16 bp, Homo sapiens
  misc_feature (1)...(16): n = A,T,C or G
agtggtgngatcttgg

SEQ ID NO: 791 - DNA, 16 bp, Homo sapiens
  misc_feature (1)...(16): n = A,T,C or G
ttaccatntaacccaa

SEQ ID NO: 792 - DNA, 20 bp, Homo sapiens
  misc_feature (1)...(20): n = A,T,C or G
tgtgtgnagacagaatcttg

SEQ ID NO: 793 - DNA, 15 bp, Homo sapiens
  misc_feature (1)...(15): n = A,T,C or G
ggttcccnggccagg

SEQ ID NO: 794 - DNA, 15 bp, Homo sapiens
  misc_feature (1)...(15): n = A,T,C or G
ggaaagangaagaag

SEQ ID NO: 795 - DNA, 17 bp, Homo sapiens
  misc_feature (1)...(17): n = A,T,C or G
cttgaggngtggtgcct

SEQ ID NO: 796 - DNA, 18 bp, Homo sapiens
  misc_feature (1)...(18): n = A,T,C or G
ttactttgnccagcttcc

SEQ ID NO: 797 - DNA, 17 bp, Homo sapiens
  misc_feature (1)...(17): n = A,T,C or G
aatggatntatgtcaga

SEQ ID NO: 798 - DNA, 17 bp, Homo sapiens
  misc_feature (1)...(17): n = A,T,C or G
agggacccnaatagttt

SEQ ID NO: 799 - DNA, 15 bp, Homo sapiens
  misc_feature (1)...(15): n = A,T,C or G
attcagangtgctgt

SEQ ID NO: 800 - DNA, 18 bp, Homo sapiens
  misc_feature (1)...(18): n = A,T,C or G
cacaagttntccacagag

SEQ ID NO: 801 - DNA, 19 bp, Homo sapiens
  misc_feature (1)...(19): n = A,T,C or G
gaatgatgcnttttttttt

SEQ ID NO: 802 - DNA, 17 bp, Homo sapiens
  misc_feature (1)...(17): n = A,T,C or G
cccaaatgntaccttat

SEQ ID NO: 803 - DNA, 16 bp, Homo sapiens
  misc_feature (1)...(16): n = A,T,C or G
tggcatanagaaggtt

SEQ ID NO: 804 - DNA, 20 bp, Homo sapiens
  misc_feature (1)...(20): n = A,T,C or G
gcctagatcncttgcttgca

SEQ ID NO: 805 - DNA, 17 bp, Homo sapiens
  misc_feature (1)...(17): n = A,T,C or G
ggccatggtntatggcc

SEQ ID NO: 806 - DNA, 18 bp, Homo sapiens
  misc_feature (1)...(18): n = A,T,C or G
agtactggnaccctgggc

SEQ ID NO: 807 - DNA, 16 bp, Homo sapiens
  misc_feature (1)...(16): n = A,T,C or G
catggtcnactacact

SEQ ID NO: 808 - DNA, 18 bp, Homo sapiens
  misc_feature (1)...(18): n = A,T,C or G
gtaccagcngctagtgga

SEQ ID NO: 809 - DNA, 17 bp, Homo sapiens
  misc_feature (1)...(17): n = A,T,C or G
aaatgggnactgtctcg

SEQ ID NO: 810 - DNA, 15 bp, Homo sapiens
  misc_feature (1)...(15): n = A,T,C or G
ggcaaacncaccacg

SEQ ID NO: 811 - DNA, 16 bp, Homo sapiens
  misc_feature (1)...(16): n = A,T,C or G
cctgtgganttggggt

SEQ ID NO: 812 - DNA, 17 bp, Homo sapiens
  misc_feature (1)...(17): n = A,T,C or G
tgtgtgtgngggtctga

SEQ ID NO: 813 - DNA, 15 bp, Homo sapiens
  misc_feature (1)...(15): n = A,T,C or G
tcgggcangcatgca

SEQ ID NO: 814 - DNA, 16 bp, Homo sapiens
  misc_feature (1)...(16): n = A,T,C or G
ttttagtntgagtccc

SEQ ID NO: 815 - DNA, 15 bp, Homo sapiens
  misc_feature (1)...(15): n = A,T,C or G
gcctcantggatttt

SEQ ID NO: 816 - DNA, 15 bp, Homo sapiens
  misc_feature (1)...(15): n = A,T,C or G
agctcctnccctcag

SEQ ID NO: 817 - DNA, 16 bp, Homo sapiens
  misc_feature (1)...(16): n = A,T,C or G
gggaagcnggtctggg

SEQ ID NO: 818 - DNA, 16 bp, Homo sapiens
  misc_feature (1)...(16): n = A,T,C or G
gaaaggantgaaatgc

SEQ ID NO: 819 - DNA, 15 bp, Homo sapiens
  misc_feature (1)...(15): n = A,T,C or G
gcctgcancacttgc

SEQ ID NO: 820 - DNA, 24 bp, Homo sapiens
  misc_feature (1)...(24): n = A,T,C or G
aaaggactgaaangccccagaggc

SEQ ID NO: 821 - DNA, 16 bp, Homo sapiens
  misc_feature (1)...(16): n = A,T,C or G
ttcacaccnggaagct

SEQ ID NO: 822 - DNA, 15 bp, Homo sapiens
  misc_feature (1)...(15): n = A,T,C or G
aggaaacnttcttct

SEQ ID NO: 823 - DNA, 16 bp, Homo sapiens
  misc_feature (1)...(16): n = A,T,C or G
ccagagangtacagaa

SEQ ID NO: 824 - DNA, 16 bp, Homo sapiens
  misc_feature (1)...(16): n = A,T,C or G
gccgggcngatagcct

SEQ ID NO: 825 - DNA, 15 bp, Homo sapiens
  misc_feature (1)...(15): n = A,T,C or G
ttgcgtanacacaca

SEQ ID NO: 826 - DNA, 18 bp, Homo sapiens
  misc_feature (1)...(18): n = A,T,C or G
gaactgganagaagtctc

SEQ ID NO: 827 - DNA, 16 bp, Homo sapiens
  misc_feature (1)...(16): n = A,T,C or G
gggagacnccttttac

SEQ ID NO: 828 - DNA, 14 bp, Homo sapiens
  misc_feature (1)...(14): n = A,T,C or G
gtgtgtgngggggg

SEQ ID NO: 829 - DNA, 16 bp, Homo sapiens
  misc_feature (1)...(16): n = A,T,C or G
gctgagancctatcat

SEQ ID NO: 830 - DNA, 15 bp, Homo sapiens
  misc_feature (1)...(15): n = A,T,C or G
gccttctntatgcag

SEQ ID NO: 831 - DNA, 15 bp, Homo sapiens
  misc_feature (1)...(15): n = A,T,C or G
tgggacangaacaac

SEQ ID NO: 832 - DNA, 16 bp, Homo sapiens
  misc_feature (1)...(16): n = A,T,C or G
ccttcccntgaggccc

SEQ ID NO: 833 - DNA, 15 bp, Homo sapiens
  misc_feature (1)...(15): n = A,T,C or G
cagccccntctcccc

SEQ ID NO: 834 - DNA, 17 bp, Homo sapiens
  misc_feature (1)...(17): n = A,T,C or G
gacagtanagcctgtga

SEQ ID NO: 835 - DNA, 18 bp, Homo sapiens
  misc_feature (1)...(18): n = A,T,C or G
gctgctatnaggtgcagg

SEQ ID NO: 836 - DNA, 17 bp, Homo sapiens
  misc_feature (1)...(17): n = A,T,C or G
ccatccttcnttttttt

SEQ ID NO: 837 - DNA, 16 bp, Homo sapiens
  misc_feature (1)...(16): n = A,T,C or G
tgtcgccnagtccagt

SEQ ID NO: 838 - DNA, 18 bp, Homo sapiens
  misc_feature (1)...(18): n = A,T,C or G
aacggagtntgtgcctct

SEQ ID NO: 839 - DNA, 15 bp, Homo sapiens
  misc_feature (1)...(15): n = A,T,C or G
gtgtgganagttaaa

SEQ ID NO: 840 - DNA, 15 bp, Homo sapiens
  misc_feature (1)...(15): n = A,T,C or G
cagtcccngagaagt

SEQ ID NO: 841 - DNA, 20 bp, Homo sapiens
  misc_feature (1)...(20): n = A,T,C or G
ttctattaangggagaatcc

SEQ ID NO: 842 - DNA, 18 bp, Homo sapiens
  misc_feature (1)...(18): n = A,T,C or G
taaatcccanatggattc

SEQ ID NO: 843 - DNA, 17 bp, Homo sapiens
  misc_feature (1)...(17): n = A,T,C or G
aataaatantcattatt

SEQ ID NO: 844 - DNA, 16 bp, Homo sapiens
  misc_feature (1)...(16): n = A,T,C or G
cccccaaccntttttt

SEQ ID NO: 845 - DNA, 17 bp, Homo sapiens
  misc_feature (1)...(17): n = A,T,C or G
ggatcatntttaaagag

SEQ ID NO: 846 - DNA, 16 bp, Homo sapiens
  misc_feature (1)...(16): n = A,T,C or G
ggaattgtnaatactt

SEQ ID NO: 847 - DNA, 16 bp, Homo sapiens
  misc_feature (1)...(16): n = A,T,C or G
tcctggcntcaaggga

SEQ ID NO: 848 - DNA, 15 bp, Homo sapiens
  misc_feature (1)...(15): n = A,T,C or G
gggaccangcagaaa

SEQ ID NO: 849 - DNA, 15 bp, Homo sapiens
  misc_feature (1)...(15): n = A,T,C or G
acaaaacncaaacaa

SEQ ID NO: 850 - DNA, 25 bp, Homo sapiens
  misc_feature (1)...(25): n = A,T,C or G
aacacaaacnaaaaaacagggccaa

SEQ ID NO: 851 - DNA, 19 bp, Homo sapiens
  misc_feature (1)...(19): n = A,T,C or G
aaacaggnccaaatgacta

SEQ ID NO: 852 - DNA, 16 bp, Homo sapiens
  misc_feature (1)...(16): n = A,T,C or G
agggaaagnaaaaaaa

SEQ ID NO: 853 - DNA, 17 bp, Homo sapiens
  misc_feature (1)...(17): n = A,T,C or G
aaacaatcnctacagtt

SEQ ID NO: 854 - DNA, 16 bp, Homo sapiens
  misc_feature (1)...(16): n = A,T,C or G
aaaacatnatacagga

SEQ ID NO: 855 - DNA, 15 bp, Homo sapiens
  misc_feature (1)...(15): n = A,T,C or G
aaaagtnaagtccta

SEQ ID NO: 856 - DNA, 17 bp, Homo sapiens
  misc_feature (1)...(17): n = A,T,C or G
gttggcaantttttttt

SEQ ID NO: 857 - DNA, 15 bp, Homo sapiens
  misc_feature (1)...(15): n = A,T,C or G
aaaacatnatacagg

SEQ ID NO: 858 - DNA, 16 bp, Homo sapiens
  misc_feature (1)...(16): n = A,T,C or G
gcactanccaaaatat

SEQ ID NO: 859 - DNA, 16 bp, Homo sapiens
  misc_feature (1)...(16): n = A,T,C or G
aacaatancaaatgtt

SEQ ID NO: 860 - DNA, 18 bp, Homo sapiens
  misc_feature (1)...(18): n = A,T,C or G
acctaggnatttcactcc

SEQ ID NO: 861 - DNA, 17 bp, Homo sapiens
  misc_feature (1)...(17): n = A,T,C or G
gaaagaanatatattgt

SEQ ID NO: 862 - DNA, 14 bp, Homo sapiens
  misc_feature (1)...(14): n = A,T,C or G
gttcaanatctgac

SEQ ID NO: 863 - DNA, 17 bp, Homo sapiens
  misc_feature (1)...(17): n = A,T,C or G
cccctgcnacctcactt

SEQ ID NO: 864 - DNA, 15 bp, Homo sapiens
  misc_feature (1)...(15): n = A,T,C or G
cacttagnctttatc

SEQ ID NO: 865 - DNA, 15 bp, Homo sapiens
  misc_feature (1)...(15): n = A,T,C or G
gggaganccacacct

SEQ ID NO: 866 - DNA, 14 bp, Homo sapiens
  misc_feature (1)...(14): n = A,T,C or G
gagacangagagga

SEQ ID NO: 867 - DNA, 17 bp, Homo sapiens
  misc_feature (1)...(17): n = A,T,C or G
aaaggatntggggtctt

SEQ ID NO: 868 - DNA, 18 bp, Homo sapiens
  misc_feature (1)...(18): n = A,T,C or G
cacacgctngcgtatgca

SEQ ID NO: 869 - DNA, 20 bp, Homo sapiens
  misc_feature (1)...(20): n = A,T,C or G
gcatataaangtgtgtgtgt

SEQ ID NO: 870 - DNA, 17 bp, Homo sapiens
  misc_feature (1)...(17): n = A,T,C or G
tgtggtgantttttttt

SEQ ID NO: 871 - DNA, 16 bp, Homo sapiens
  misc_feature (1)...(16): n = A,T,C or G
tgagtctcnaaaaaaa

SEQ ID NO: 872 - DNA, 17 bp, Homo sapiens
  misc_feature (1)...(17): n = A,T,C or G
ctccaccnttgttcccc

SEQ ID NO: 873 - DNA, 14 bp, Homo sapiens
  misc_feature (1)...(14): n = A,T,C or G
aggactnatctcta

SEQ ID NO: 874 - DNA, 16 bp, Homo sapiens
  misc_feature (1)...(16): n = A,T,C or G
ctgcttcnaggagcca

SEQ ID NO: 875 - DNA, 15 bp, Homo sapiens
  misc_feature (1)...(15): n = A,T,C or G
taatggantaaggat

SEQ ID NO: 876 - DNA, 19 bp, Homo sapiens
  misc_feature (1)...(19): n = A,T,C or G
cacatggttncaatgtcac

SEQ ID NO: 877 - DNA, 17 bp, Homo sapiens
  misc_feature (1)...(17): n = A,T,C or G
aagatctcnagggtggg

SEQ ID NO: 878 - DNA, 16 bp, Homo sapiens
  misc_feature (1)...(16): n = A,T,C or G
gacaggnatgttctat

SEQ ID NO: 879 - DNA, 18 bp, Homo sapiens
  misc_feature (1)...(18): n = A,T,C or G
gagacaggnatgttctat

SEQ ID NO: 880 - DNA, 19 bp, Homo sapiens
  misc_feature (1)...(19): n = A,T,C or G
aaaaaaccttnggctgtct

SEQ ID NO: 881 - DNA, 19 bp, Homo sapiens
  misc_feature (1)...(19): n = A,T,C or G
ctgccctggnttacctggg

SEQ ID NO: 882 - DNA, 21 bp, Homo sapiens
  misc_feature (1)...(21): n = A,T,C or G
ttttgtgtgtgtggntttttt

SEQ ID NO: 883 - DNA, 16 bp, Homo sapiens
  misc_feature (1)...(16): n = A,T,C or G
gccacatntgtcatca

SEQ ID NO: 884 - DNA, 27 bp, Homo sapiens
  misc_feature (1)...(27): n = A,T,C or G
agagacacacctgggnagagatgctgg

SEQ ID NO: 885 - DNA, 21 bp, Homo sapiens
  misc_feature (1)...(21): n = A,T,C or G
cccacttccaaccntgtctgg

SEQ ID NO: 886 - DNA, 13 bp, Homo sapiens
  misc_feature (1)...(13): n = A,T,C or G
gagaggntgatgt

SEQ ID NO: 887 - DNA, 15 bp, Homo sapiens
  misc_feature (1)...(15): n = A,T,C or G
gggccagngcaagtt

SEQ ID NO: 888 - DNA, 15 bp, Homo sapiens
  misc_feature (1)...(15): n = A,T,C or G
aacctanggggaggg

SEQ ID NO: 889 - DNA, 14 bp, Homo sapiens
  misc_feature (1)...(14): n = A,T,C or G
tcccgcntgtgtct

SEQ ID NO: 890 - DNA, 14 bp, Homo sapiens
  misc_feature (1)...(14): n = A,T,C or G
actgtcnccaactt

SEQ ID NO: 891 - DNA, 14 bp, Homo sapiens
  misc_feature (1)...(14): n = A,T,C or G
tctaccnttttttt

SEQ ID NO: 892 - DNA, 16 bp, Homo sapiens
  misc_feature (1)...(16): n = A,T,C or G
gtgctgtnggactgaa

SEQ ID NO: 893 - DNA, 17 bp, Homo sapiens
  misc_feature (1)...(17): n = A,T,C or G
caggtggnatgttcttg

SEQ ID NO: 894 - DNA, 18 bp, Homo sapiens
  misc_feature (1)...(18): n = A,T,C or G
ccactgggnccctggctt

SEQ ID NO: 895 - DNA, 17 bp, Homo sapiens
  misc_feature (1)...(17): n = A,T,C or G
tgtttgtantcttctcc

SEQ ID NO: 896 - DNA, 17 bp, Homo sapiens
  misc_feature (1)...(17): n = A,T,C or G
aggaactgnctcgacat

SEQ ID NO: 897 - DNA, 18 bp, Homo sapiens
  misc_feature (1)...(18): n = A,T,C or G
cttctaggancatttcag

SEQ ID NO: 898 - DNA, 18 bp, Homo sapiens
  misc_feature (1)...(18): n = A,T,C or G
tgcagaatncagtggagc

SEQ ID NO: 899 - DNA, 23 bp, Homo sapiens
  misc_feature (1)...(23): n = A,T,C or G
cttcttcttcntttttttttttt

SEQ ID NO: 900 - DNA, 21 bp, Homo sapiens
  misc_feature (1)...(21): n = A,T,C or G
tttctgtcgctntgattttgg

SEQ ID NO: 901 - DNA, 21 bp, Homo sapiens
  misc_feature (1)...(21): n = A,T,C or G
cttctttatcntttttttttt

SEQ ID NO: 902 - DNA, 21 bp, Homo sapiens
  misc_feature (1)...(21): n = A,T,C or G
ttcatctcntttttttttttt

SEQ ID NO: 903 - DNA, 40 bp, Homo sapiens
  misc_feature (1)...(40): n = A,T,C or G
aatttatcctccttttcaaagaanttgaatttttgaatct

SEQ ID NO: 904 - DNA, 20 bp, Homo sapiens
  misc_feature (1)...(20): n = A,T,C or G
gttccttccgntttttccac

SEQ ID NO: 905 - DNA, 31 bp, Homo sapiens
  misc_feature (1)...(31): n = A,T,C or G
cctgagaggcatcaaantcaaatatgatcaa

SEQ ID NO: 906 - DNA, 30 bp, Homo sapiens
  misc_feature (1)...(30): n = A,T,C or G
catctcatttgtatcngtcacctgattggg

SEQ ID NO: 907 - DNA, 38 bp, Homo sapiens
  misc_feature (1)...(38): n = A,T,C or G
tttgggagggtgaggtgggnggatcaggaggtcaggag

SEQ ID NO: 908 - DNA, 16 bp, Homo sapiens
  misc_feature (1)...(16): n = A,T,C or G
ggaccaanctggggtg

SEQ ID NO: 909 - DNA, 19 bp, Homo sapiens
  misc_feature (1)...(19): n = A,T,C or G
aaaaaaaaaangtttcccc

SEQ ID NO: 910 - DNA, 38 bp, Homo sapiens
  misc_feature (1)...(38): n = A,T,C or G
cagataagcatcagatttgnaaacttacaatgggaatg

SEQ ID NO: 911 - DNA, 31 bp, Homo sapiens
  misc_feature (1)...(31): n = A,T,C or G
tattgtattccaattntggatgtagccacca

SEQ ID NO: 912 - DNA, 40 bp, Homo sapiens
  misc_feature (1)...(40): n = A,T,C or G
tattcctagtctgtggagaggntttttgtttgtttgtttg

SEQ ID NO: 913 - DNA, 24 bp, Homo sapiens
  misc_feature (1)...(24): n = A,T,C or G
tttgtttntttagacagagtctca

SEQ ID NO: 914 - DNA, 36 bp, Homo sapiens
  misc_feature (1)...(36): n = A,T,C or G
tatattttagttttcatngtgaattcttctttgacc

SEQ ID NO: 915 - DNA, 13 bp, Homo sapiens
  misc_feature (1)...(13): n = A,T,C or G
tacctcntttttt

SEQ ID NO: 916 - DNA, 18 bp, Homo sapiens
  misc_feature (1)...(18): n = A,T,C or G
ttttttttnaaccttaaa

SEQ ID NO: 917 - DNA, 13 bp, Homo sapiens
  misc_feature (1)...(13): n = A,T,C or G
catctcnaaaaaa

SEQ ID NO: 918 - DNA, 16 bp, Homo sapiens
  misc_feature (1)...(16): n = A,T,C or G
aaaaaaaangagagag

SEQ ID NO: 919 - DNA, 15 bp, Homo sapiens
  misc_feature (1)...(15): n = A,T,C or G
agactancacagaaa

SEQ ID NO: 920 - DNA, 13 bp, Homo sapiens
  misc_feature (1)...(13): n = A,T,C or G
ccacatnctctcc

SEQ ID NO: 921 - DNA, 13 bp, Homo sapiens
  misc_feature (1)...(13): n = A,T,C or G
gatggtnagcatt

SEQ ID NO: 922 - DNA, 13 bp, Homo sapiens
  misc_feature (1)...(13): n = A,T,C or G
tttcatntgtttt

SEQ ID NO: 923 - DNA, 13 bp, Homo sapiens
  misc_feature (1)...(13): n = A,T,C or G
aatgatngccatt

SEQ ID NO: 924 - DNA, 13 bp, Homo sapiens
  misc_feature (1)...(13): n = A,T,C or G
gttcatntccttg

SEQ ID NO: 925 - DNA, 15 bp, Homo sapiens
  misc_feature (1)...(15): n = A,T,C or G
gatttttntataagg

SEQ ID NO: 926 - DNA, 13 bp, Homo sapiens
  misc_feature (1)...(13): n = A,T,C or G
tctaacntttaag

SEQ ID NO: 927 - DNA, 13 bp, Homo sapiens
  misc_feature (1)...(13): n = A,T,C or G
catgagnatggaa

SEQ ID NO: 928 - DNA, 15 bp, Homo sapiens
  misc_feature (1)...(15): n = A,T,C or G
cctgcctnattgccc

SEQ ID NO: 929 - DNA, 15 bp, Homo sapiens
  misc_feature (1)...(15): n = A,T,C or G
cctgccnaattgccc

SEQ ID NO: 930 - DNA, 15 bp, Homo sapiens
  misc_feature (1)...(15): n = A,T,C or G
gaatgttnttccatt

SEQ ID NO: 931 - DNA, 14 bp, Homo sapiens
  misc_feature (1)...(14): n = A,T,C or G
gatttggntctctg

SEQ ID NO: 932 - DNA, 13 bp, Homo sapiens
  misc_feature (1)...(13): n = A,T,C or G
tgtttgnctgttg

SEQ ID NO: 933 - DNA, 13 bp, Homo sapiens
  misc_feature (1)...(13): n = A,T,C or G
agttgcntatcag

SEQ ID NO: 934 - DNA, 13 bp, Homo sapiens
  misc_feature (1)...(13): n = A,T,C or G
ggctganacaatg

SEQ ID NO: 935 - DNA, 13 bp, Homo sapiens
  misc_feature (1)...(13): n = A,T,C or G
gggatcngtggtg

SEQ ID NO: 936 - DNA, 13 bp, Homo sapiens
  misc_feature (1)...(13): n = A,T,C or G
ttattgngtctat

SEQ ID NO: 937 - DNA, 13 bp, Homo sapiens
  misc_feature (1)...(13): n = A,T,C or G
attcttntctctt

SEQ ID NO: 938 - DNA, 13 bp, Homo sapiens
  misc_feature (1)...(13): n = A,T,C or G
tgggagngtgtat

SEQ ID NO: 939 - DNA, 13 bp, Homo sapiens
  misc_feature (1)...(13): n = A,T,C or G
tcttttnttcttt

SEQ ID NO: 940 - DNA, 14 bp, Homo sapiens
  misc_feature (1)...(14): n = A,T,C or G
gtgtcanttttgga

SEQ ID NO: 941 - DNA, 15 bp, Homo sapiens
  misc_feature (1)...(15): n = A,T,C or G
cttttccnttttttt

SEQ ID NO: 942 - DNA, 14 bp, Homo sapiens
  misc_feature (1)...(14): n = A,T,C or G
agacagncttgctc

SEQ ID NO: 943 - DNA, 13 bp, Homo sapiens
  misc_feature (1)...(13): n = A,T,C or G
ggctatngaaaaa

SEQ ID NO: 944 - DNA, 14 bp, Homo sapiens
  misc_feature (1)...(14): n = A,T,C or G
gctggancataaag

SEQ ID NO: 945 - DNA, 15 bp, Homo sapiens
  misc_feature (1)...(15): n = A,T,C or G
ctttttnaaaatagg

SEQ ID NO: 946 - DNA, 17 bp, Homo sapiens
  misc_feature (1)...(17): n = A,T,C or G
aatctttanagtacatt

SEQ ID NO: 947 - DNA, 22 bp, Homo sapiens
  misc_feature (1)...(22): n = A,T,C or G
gttgaaatcntttttttttttt

SEQ ID NO: 948 - DNA, 14 bp, Homo sapiens
  misc_feature (1)...(14): n = A,T,C or G
ccctacangtaaat

SEQ ID NO: 949 - DNA, 16 bp, Homo sapiens
  misc_feature (1)...(16): n = A,T,C or G
aaatatanacatttat

SEQ ID NO: 950 - DNA, 14 bp, Homo sapiens
  misc_feature (1)...(14): n = A,T,C or G
cgccttcnataaaa

SEQ ID NO: 951 - DNA, 14 bp, Homo sapiens
  misc_feature (1)...(14): n = A,T,C or G
tataaggtntaagg

SEQ ID NO: 952 - DNA, 16 bp, Homo sapiens
  misc_feature (1)...(16): n = A,T,C or G
tcccattntgtaggtt

SEQ ID NO: 953 - DNA, 15 bp, Homo sapiens
  misc_feature (1)...(15): n = A,T,C or G
aattagancccattt

SEQ ID NO: 954 - DNA, 13 bp, Homo sapiens
  misc_feature (1)...(13): n = A,T,C or G
tcttccntttgtt

SEQ ID NO: 955 - DNA, 13 bp, Homo sapiens
  misc_feature (1)...(13): n = A,T,C or G
gtggttngtagtt

SEQ ID NO: 956 - DNA, 13 bp, Homo sapiens
  misc_feature (1)...(13): n = A,T,C or G
ccttcangtccct

SEQ ID NO: 957 - DNA, 12 bp, Homo sapiens
  misc_feature (1)...(12): n = A,T,C or G
cttcatntccct

SEQ ID NO: 958 - DNA, 13 bp, Homo sapiens
  misc_feature (1)...(13): n = A,T,C or G
actcatngtttgg

SEQ ID NO: 959 - DNA, 13 bp, Homo sapiens
  misc_feature (1)...(13): n = A,T,C or G
ctcattntttggc

SEQ ID NO: 960 - DNA, 15 bp, Homo sapiens
  misc_feature (1)...(15): n = A,T,C or G
ctctctcnttttttt

SEQ ID NO: 961 - DNA, 15 bp, Homo sapiens
  misc_feature (1)...(15): n = A,T,C or G
catgtcncctgcaaa

SEQ ID NO: 962 - DNA, 13 bp, Homo sapiens
  misc_feature (1)...(13): n = A,T,C or G
tttgtgngcagag

SEQ ID NO: 963 - DNA, 16 bp, Homo sapiens
  misc_feature (1)...(16): n = A,T,C or G
tttttttngctcatca

SEQ ID NO: 964 - DNA, 18 bp, Homo sapiens
  misc_feature (1)...(18): n = A,T,C or G
gcctcatgnacccctacc

SEQ ID NO: 965 - DNA, 17 bp, Homo sapiens
  misc_feature (1)...(17): n = A,T,C or G
ctcacaaangctccagt

SEQ ID NO: 966 - DNA, 17 bp, Homo sapiens
  misc_feature (1)...(17): n = A,T,C or G
gctggaggnaggactag

SEQ ID NO: 967 - DNA, 17 bp, Homo sapiens
  misc_feature (1)...(17): n = A,T,C or G
gtcaaattnattcattt

SEQ ID NO: 968 - DNA, 18 bp, Homo sapiens
  misc_feature (1)...(18): n = A,T,C or G
tccagctgangatgcagg

SEQ ID NO: 969 - DNA, 18 bp, Homo sapiens
  misc_feature (1)...(18): n = A,T,C or G
agccctgantgggcacca

SEQ ID NO: 970 - DNA, 19 bp, Homo sapiens
  misc_feature (1)...(19): n = A,T,C or G
cacccctgctntatacact

SEQ ID NO: 971 - DNA, 16 bp, Homo sapiens
  misc_feature (1)...(16): n = A,T,C or G
ctatacantggttggt

SEQ ID NO: 972 - DNA, 20 bp, Homo sapiens
  misc_feature (1)...(20): n = A,T,C or G
ccaggtcaagntgctgagtg

SEQ ID NO: 973 - DNA, 18 bp, Homo sapiens
  misc_feature (1)...(18): n = A,T,C or G
tagtggtgnagtctgggc

SEQ ID NO: 974 - DNA, 17 bp, Homo sapiens
  misc_feature (1)...(17): n = A,T,C or G
cgtacccantaggtaat

SEQ ID NO: 975 - DNA, 19 bp, Homo sapiens
  misc_feature (1)...(19): n = A,T,C or G
ctgggagganctggggact

SEQ ID NO: 976 - DNA, 19 bp, Homo sapiens
  misc_feature (1)...(19): n = A,T,C or G
gtgatgggntgccttaaag

SEQ ID NO: 977 - DNA, 18 bp, Homo sapiens
  misc_feature (1)...(18): n = A,T,C or G
atctggtaanaggtgtgg

SEQ ID NO: 978 - DNA, 18 bp, Homo sapiens
  misc_feature (1)...(18): n = A,T,C or G
gaaacaggngcggtggca

SEQ ID NO: 979 - DNA, 19 bp, Homo sapiens
  misc_feature (1)...(19): n = A,T,C or G
ctctgaaggntcatcacag

SEQ ID NO: 980 - DNA, 21 bp, Homo sapiens
  misc_feature (1)...(21): n = A,T,C or G
ctctccaagcncctgctagta

SEQ ID NO: 981 - DNA, 22 bp, Homo sapiens
  misc_feature (1)...(22): n = A,T,C or G
ctctttattantccctttccca

SEQ ID NO: 982 - DNA, 20 bp, Homo sapiens
  misc_feature (1)...(20): n = A,T,C or G
gatgaaggantgggtcatgc

SEQ ID NO: 983 - DNA, 17 bp, Homo sapiens
  misc_feature (1)...(17): n = A,T,C or G
tgctaccangtgagcca

SEQ ID NO: 984 - DNA, 20 bp, Homo sapiens
  misc_feature (1)...(20): n = A,T,C or G
aggtgagccancaggatgag

SEQ ID NO: 985 - DNA, 18 bp, Homo sapiens
  misc_feature (1)...(18): n = A,T,C or G
tcacaacanaagtctcag

SEQ ID NO: 986 - DNA, 24 bp, Homo sapiens
  misc_feature (1)...(24): n = A,T,C or G
aggggtggactgtnatctgttcct

SEQ ID NO: 987 - DNA, 28 bp, Homo sapiens
  misc_feature (1)...(28): n = A,T,C or G
ttcatgaaagacnttttttttttttttg

SEQ ID NO: 988 - DNA, 21 bp, Homo sapiens
  misc_feature (1)...(21): n = A,T,C or G
tgccctctcngggccttgggg

SEQ ID NO: 989 - DNA, 23 bp, Homo sapiens
  misc_feature (1)...(23): n = A,T,C or G
agtgtggggatgnaacctccagc

SEQ ID NO: 990 - DNA, 19 bp, Homo sapiens
  misc_feature (1)...(19): n = A,T,C or G
ctccttccgnccaggttga

SEQ ID NO: 991 - DNA, 21 bp, Homo sapiens
  misc_feature (1)...(21): n = A,T,C or G
tttcctccctnccctgcctca

SEQ ID NO: 992 - DNA, 19 bp, Homo sapiens
  misc_feature (1)...(19): n = A,T,C or G
cacggccagnagcctcttg

SEQ ID NO: 993 - DNA, 27 bp, Homo sapiens
  misc_feature (1)...(27): n = A,T,C or G
ttcagagggggtgnggctgggtcaagt

SEQ ID NO: 994 - DNA, 18 bp, Homo sapiens
  misc_feature (1)...(18): n = A,T,C or G
cactgtggnctgagtctg

SEQ ID NO: 995 - DNA, 22 bp, Homo sapiens
  misc_feature (1)...(22): n = A,T,C or G
catgtacaggngacagatctgg

SEQ ID NO: 996 - DNA, 18 bp, Homo sapiens
  misc_feature (1)...(18): n = A,T,C or G
aagtgtgcntgaatgtga

SEQ ID NO: 997 - DNA, 21 bp, Homo sapiens
  misc_feature (1)...(21): n = A,T,C or G
tcaacccctgnatctgtacaa

SEQ ID NO: 998 - DNA, 18 bp, Homo sapiens
  misc_feature (1)...(18): n = A,T,C or G
cacagggagngtttgaga

SEQ ID NO: 999 - DNA, 19 bp, Homo sapiens
  misc_feature (1)...(19): n = A,T,C or G
cttgtcctngtggggagga

SEQ ID NO: 1000 - DNA, 21 bp, Homo sapiens
  misc_feature (1)...(21): n = A,T,C or G
tcgagcctgnctgatggcaaa

SEQ ID NO: 1001 - DNA, 21 bp, Homo sapiens
  misc_feature (1)...(21): n = A,T,C or G
ggaggttgtagngcagaagtt

SEQ ID NO: 1002 - DNA, 17 bp, Homo sapiens
  misc_feature (1)...(17): n = A,T,C or G
ggccatccancagaaac

SEQ ID NO: 1003 - DNA, 17 bp, Homo sapiens
  misc_feature (1)...(17): n = A,T,C or G
tcccccacnctgatcac

SEQ ID NO: 1004 - DNA, 22 bp, Homo sapiens
  misc_feature (1)...(22): n = A,T,C or G
gaattgtgcctanggagtacgc

SEQ ID NO: 1005 - DNA, 20 bp, Homo sapiens
  misc_feature (1)...(20): n = A,T,C or G
actgcagcctngacctccca

SEQ ID NO: 1006 - DNA, 18 bp, Homo sapiens
  misc_feature (1)...(18): n = A,T,C or G
ttccgggtcanagtacct

SEQ ID NO: 1007 - DNA, 14 bp, Homo sapiens
  misc_feature (1)...(14): n = A,T,C or G
acccgtnataattc

SEQ ID NO: 1008 - DNA, 17 bp, Homo sapiens
  misc_feature (1)...(17): n = A,T,C or G
tctaaactngggggaaa

SEQ ID NO: 1009 - DNA, 15 bp, Homo sapiens
  misc_feature (1)...(15): n = A,T,C or G
ggggaaacntttttt

SEQ ID NO: 1010 - DNA, 16 bp, Homo sapiens
  misc_feature (1)...(16): n = A,T,C or G
tttttttngagatgga

SEQ ID NO: 1011 - DNA, 17 bp, Homo sapiens
  misc_feature (1)...(17): n = A,T,C or G
attccttgngttggcct

SEQ ID NO: 1012 - DNA, 15 bp, Homo sapiens
  misc_feature (1)...(15): n = A,T,C or G
tttgctcngctgcct

SEQ ID NO: 1013 - DNA, 16 bp, Homo sapiens
  misc_feature (1)...(16): n = A,T,C or G
atcaggtnatgtttta

SEQ ID NO: 1014 - DNA, 18 bp, Homo sapiens
  misc_feature (1)...(18): n = A,T,C or G
tctagtgangacacccag

SEQ ID NO: 1015 - DNA, 16 bp, Homo sapiens
  misc_feature (1)...(16): n = A,T,C or G
acagatcttnaaaaaa

SEQ ID NO: 1016 - DNA, 47 bp, Homo sapiens
  misc_feature (1)...(47): n = A,T,C or G
aaactttttcgcgagggacngttcaactgaaacttcgaaagcatcat

SEQ ID NO: 1017 - DNA, 45 bp, Homo sapiens
  misc_feature (1)...(45): n = A,T,C or G
ttggggaagactgtggctgctngcacttggagccaagggttcaga

SEQ ID NO: 1018 - DNA, 41 bp, Homo sapiens
  misc_feature (1)...(41): n = A,T,C or G
agcactaaagcagtggancccaggagtccctggtaataagt

SEQ ID NO: 1019 - DNA, 45 bp, Homo sapiens
  misc_feature (1)...(45): n = A,T,C or G
cgagtaatttattgtttttcctngtatttaaatattaaatatgtt

SEQ ID NO: 1020 - DNA, 62 bp, Homo sapiens
  misc_feature (1)...(62): n = A,T,C or G
ccaagctcccatgacccagacaacgnccttgaagacaagctgggttaactgctctaacatga

SEQ ID NO: 1021 - DNA, 57 bp, Homo sapiens
  misc_feature (1)...(57): n = A,T,C or G
tcgttagcttctcctgataaactaattgnctcacattgtcactgcaaatcgacacct

SEQ ID NO: 1022 - DNA, 47 bp, Homo sapiens
  misc_feature (1)...(47): n = A,T,C or G
acacctaaacttgggagaacattgtnccccagtgctggggtaggaga

SEQ ID NO: 1023 - DNA, 46 bp, Homo sapiens
  misc_feature (1)...(46): n = A,T,C or G
tgctcatgaacagaatacatanagatccaggagtctggacatcatc

SEQ ID NO: 1024 - DNA, 59 bp, Homo sapiens
  misc_feature (1)...(59): n = A,T,C or G
tgtgaatggtgatgccaaccctgtttgaacncaaaaggatgataaagttggaattggta

SEQ ID NO: 1025 - DNA, 56 bp, Homo sapiens
  misc_feature (1)...(56): n = A,T,C or G
gtgaatggtgatgccaaccctgtttgaacncaaaaggatgataaagttggaattgg

SEQ ID NO: 1026 - DNA, 50 bp, Homo sapiens
  misc_feature (1)...(50): n = A,T,C or G
ttcctgtgaacagccatgcaaccaaaccanggcaggcaacgcgctgacat

SEQ ID NO: 1027 - DNA, 48 bp, Homo sapiens
  misc_feature (1)...(48): n = A,T,C or G
cctgtgaacagccatgcaaccaaaccanggcaggcaacgcgctgacat

SEQ ID NO: 1028 - DNA, 53 bp, Homo sapiens
  misc_feature (1)...(53): n = A,T,C or G
aagacgtgcgcccgagccccgccgaancgaggccacccggagccgtgcccagt

SEQ ID NO: 1029 - DNA, 52 bp, Homo sapiens
  misc_feature (1)...(52): n = A,T,C or G
cacggggcagggtaggctttctgcctncttcacttccccagggcaggtgagt

SEQ ID NO: 1030 - DNA, 28 bp, Homo sapiens
  misc_feature (1)...(28): n = A,T,C or G
ctgacctgtggggtcncctgccagacct

SEQ ID NO: 1031 - DNA, 25 bp, Homo sapiens
  misc_feature (1)...(25): n = A,T,C or G
gccactccgactnctccaagagctg

SEQ ID NO: 1032 - DNA, 28 bp, Homo sapiens
  misc_feature (1)...(28): n = A,T,C or G
tcccatccacgtttnttggctgccactc

SEQ ID NO: 1033 - DNA, 24 bp, Homo sapiens
gtagggctatattattttatggtt

SEQ ID NO: 1034 - DNA, 49 bp, Homo sapiens
  misc_feature (1)...(49): n = A,T,C or G
ggggcagggtaggctttctgcctncttcacttccccagggcaggtgagt

SEQ ID NO: 1035 - DNA, 55 bp, Homo sapiens
  misc_feature (1)...(55): n = A,T,C or G
gaatcaaatatcactgctggtacagctntgttgttcatttttgcagctttttgga

SEQ ID NO: 1036 - DNA, 47 bp, Homo sapiens
  misc_feature (1)...(47): n = A,T,C or G
gctgttagaaattggggcgcgaanccggggaccgttcctgggaaaca

SEQ ID NO: 1037 - DNA, 52 bp, Homo sapiens
  misc_feature (1)...(52): n = A,T,C or G
gccctgagtcaggcatcaatgcaganttagtgttttttcagggctctggcag

SEQ ID NO: 1038 - DNA, 56 bp, Homo sapiens
  misc_feature (1)...(56): n = A,T,C or G
ggatatctgcatttccaggtcacttattanttaccatagcagcaaagacataatgg

SEQ ID NO: 1039 - DNA, 31 bp, Homo sapiens
cttatgcatgcaactctcacttcaccttgac

SEQ ID NO: 1040 - DNA, 57 bp, Homo sapiens
  misc_feature (1)...(57): n = A,T,C or G
ctcagtcatgtgtgacagatgttcctttgntagagttctttgcctaccagagttctc

SEQ ID NO: 1041 - DNA, 44 bp, Homo sapiens
  misc_feature (1)...(44): n = A,T,C or G
gtcgcgccccggctccagcccnagcgccgagaagttggcgatgg

SEQ ID NO: 1042 - DNA, 52 bp, Homo sapiens
  misc_feature (1)...(52): n = A,T,C or G
accctgtcccccttgagggacatcacagntgtctccagaaaggtaggtgatg

SEQ ID NO: 1043 - DNA, 25 bp, Homo sapiens
tctcggtctcacagtgcccatgcta

SEQ ID NO: 1044 - DNA, 42 bp, Homo sapiens
  misc_feature (1)...(42): n = A,T,C or G
gccagtgggcacatggggcacanggtcacactcaccaccaga

SEQ ID NO: 1045 - DNA, 48 bp, Homo sapiens
  misc_feature (1)...(48): n = A,T,C or G
actcaccaccagagtgccacgcanagcacccccggcatcgtcagcgcc

SEQ ID NO: 1046 - DNA, 50 bp, Homo sapiens
  misc_feature (1)...(50): n = A,T,C or G
aacttccctaggccttgtcagtaanaaatcagagtgaatgaaaatgagga

SEQ ID NO: 1047 - DNA, 48 bp, Homo sapiens
  misc_feature (1)...(48): n = A,T,C or G
tatccttttcactctctgatgacanaggctttgaattttgtctgaggc

SEQ ID NO: 1048 - DNA, 49 bp, Homo sapiens
  misc_feature (1)...(49): n = A,T,C or G
gcaagttaggagtatcaagcgaaanccaaaatagcccactgatatggtc

SEQ ID NO: 1049 - DNA, 56 bp, Homo sapiens
  misc_feature (1)...(56): n = A,T,C or G
gcctataagaggaaacctttgagaggntgatgtggggctggcctggttacttcatg

SEQ ID NO: 1050 - DNA, 52 bp, Homo sapiens
  misc_feature (1)...(52): n = A,T,C or G
ctatccagtggctcaggctttccttgaagngggaatctctttccctaatcca

SEQ ID NO: 1051 - DNA, 21 bp, Homo sapiens
  misc_feature (1)...(21): n = A,T,C or G
tctctctgtanaaagactgaa

SEQ ID NO: 1052 - DNA, 20 bp, Homo sapiens
  misc_feature (1)...(20): n = A,T,C or G
agactgtctcnaaaaataaa

SEQ ID NO: 1053 - DNA, 24 bp, Homo sapiens
  misc_feature (1)...(24): n = A,T,C or G
ttaaaataatttnacaaaaaacat

SEQ ID NO: 1054 - DNA, 17 bp, Homo sapiens
  misc_feature (1)...(17): n = A,T,C or G
atttaggancccccccc

SEQ ID NO: 1055 - DNA, 34 bp, Homo sapiens
  misc_feature (1)...(34): n = A,T,C or G
cctttctgctttttaaantttttctgttaaaaag

SEQ ID NO: 1056 - DNA, 34 bp, Homo sapiens
  misc_feature (1)...(34): n = A,T,C or G
ttaatggactacaaagtntatttaagggttacaa

SEQ ID NO: 1057 - DNA, 34 bp, Homo sapiens
  misc_feature (1)...(34): n = A,T,C or G
gagattcttcattcanacagaaaatgtataacat

SEQ ID NO: 1058 - DNA, 36 bp, Homo sapiens
  misc_feature (1)...(36): n = A,T,C or G
ttctaaatatttattttgncaccagcgtcaagacaa

SEQ ID NO: 1059 - DNA, 34 bp, Homo sapiens
  misc_feature (1)...(34): n = A,T,C or G
attaagactcccaagcnaatcctgcatattccaa

SEQ ID NO: 1060 - DNA, 22 bp, Homo sapiens
  misc_feature (1)...(22): n = A,T,C or G
gtgtgtgtccacngaggcacgg

SEQ ID NO: 1061 - DNA, 24 bp, Homo sapiens
  misc_feature (1)...(24): n = A,T,C or G
tccctgttaagtngggctcatgga

SEQ ID NO: 1062 - DNA, 22 bp, Homo sapiens
  misc_feature (1)...(22): n = A,T,C or G
tgtcagggcctgncctcagaca

SEQ ID NO: 1063 - DNA, 23 bp, Homo sapiens
  misc_feature (1)...(23): n = A,T,C or G
ccccagacctangacctccagga

SEQ ID NO: 1064 - DNA, 58 bp, Homo sapiens
  misc_feature (1)...(58): n = A,T,C or G
cactttgcctgcaggtgcaccgaaaggacntgggggataaaattcaaaaaagtgtgat

SEQ ID NO: 1065 - DNA, 700 bp, Homo sapiens
ggcccgaaaggactgtgccccctccccgtcaaacaccccccccccgcgtcccccaccaagttctggccggggctgtggagcgtgggtcacctgggggcgaaggactccacatcacggtgaagtggaggtgctgcagcccccacaaagcccgagaagcctgccaggggcgccccgggcgaacggcagtgggcgtgggccgttctgcagcacccattggcgcgggggaggagagtgctgatcccatcaagccccgctccaggtcgcggccgctgggcctggcccaggagcctcccccggcctcggggccccatgggactgacagggggctgagttctctttcctcccaacggcggtgtttataagaaatgaagctccgcagcggccatcagcggcagcccacactgtcaccccgccccgctctcagggggttccggaacagccctgagcactggagcaattccttggctcagtattctatcatgaccccctagtgattttccagccagcttcagccccacattctgcatttaggaattttataacagtgcaacgtttattctgctgtgtcatacagcatattttgccaaacctttgagaggggaggggctggtctggtgccccagtgtatctccagaaccaaacctggggttcaccaaaaagcaggcctgcgtgattcatatgtgttgaatgaattaaggga

SEQ ID NO: 1066 - DNA, 700 bp, Homo sapiens
cagccagcttcagccccacattctgcatttaggaattttataacagtgcaacgtttattctgctgtgtcatacagcatattttgccaaacctttgagaggggaggggctggtctggtgccccagtgtatctccagaaccaaacctggggttcaccaaaaagcaggcctgcgtgattcatatgtgttgaatgaattaagggactttctttctctccagttaggctccttgcaggcagggtgatgacccttggattctgccttcaagcttttggatgcttttatttctggcttgtgttctgcaattcacagtttaggactgcctgcctcccaggtttctgtgaaaatcgagatgaaggatttgagcatttcagagagccctactacttctggacctggaacctggaaggcatgctggggagtttgtctgctttggggaccgtggccccctctctgggtagcaggctccacaggtagcaggtctcccagtcgaaaacctagttcaggtcgggcgccgtggctcatgcctataatcccagcactttgggaggccgaggcggtggatcacctgaggtcaggagttggagaacagcctggccaatgtggtgaaactccatctccaccaaaaatacaaaaattagctgggcatggtggcgggtgcctgtaatcccagctacttgggaggctgaggcaggagaattgc

SEQ ID NO: 1067 - DNA, 700 bp, Homo sapiens
tcaggtcgggcgccgtggctcatgcctataatcccagcactttgggaggccgaggcggtggatcacctgaggtcaggagttggagaacagcctggccaatgtggtgaaactccatctccaccaaaaatacaaaaattagctgggcatggtggcgggtgcctgtaatcccagctacttgggaggctgaggcaggagaattgctgaacccctggaggtagaggttgcagtgagccgagatcacgtcactgcactccagcctgggtgacagagcgagactccgtctcaaaaaaacaaaacaaaaaaacacctagtttaaacctcactggcacctgcacctcagctctcacaaactctcatttctgagcacacactcatctctatcagcagaggatttaaccacaggttgccaagaaatgtctgtatctgagagaattcataatctgagatagaaggaacactaaactccagaggaagaggggtcacacatcaacttaactaggatttactgagtgcctaccatggtagccactcttcgggggagtgcaaggatggcggcatcaccttagtgtggtccgtgtggccctgtgcattgatgtgtgtgtgcatggtgacatgttgggagccatgcttctgggcttcaggactaactgcagcccacttagggggtgaacagtgttttgagagcctgagggaggggact

SEQ ID NO: 1068 - DNA, 700 bp, Homo sapiens
gatttactgagtgcctaccatggtagccactcttcgggggagtgcaaggatggcggcatcaccttagtgtggtccgtgtggccctgtgcattgatgtgtgtgtgcatggtgacatgttgggagccatgcttctgggcttcaggactaactgcagcccacttagggggtgaacagtgttttgagagcctgagggaggggactggggacaagaattgtctgtcagggtagaggctcccacagggtgtgtgaatgtgtgtgtgagatgatcttgccttcagcatcctgattgcagaagtcacttcaaaggagcccctgccagccagttagcctcctcttgccagcacagaaaaatccaggtcccaatacagagaggccacacaatgaattcaccctcattgagtgaggctatggatgagaggcatctgtaaggaagaccttgcacagtgcagggtgctggctaccctcagctaacccctagctcgcttcagctgctgggcatgaggaacctgcttagatttctcacagaaaacatggagagttctttttctcacagaaaaaatgtagagtttgttccccagagtttgttcccaccatgtagaaagtgaccagtggtgaaaaggaaacataggaaagttaaggaccaaagggtccaaggagggaaaagaaaggacttctggttggttgctttgcgggcattttg

SEQ ID NO: 1069 - DNA, 700 bp, Homo sapiens
gaggaacctgcttagatttctcacagaaaacatggagagttctttttctcacagaaaaaatgtagagtttgttccccagagtttgttcccaccatgtagaaagtgaccagtggtgaaaaggaaacataggaaagttaaggaccaaagggtccaaggagggaaaagaaaggacttctggttggttgctttgcgggcattttgaagagatcaggcatatgctctgggccttaaaaaaagacacagagattgaagtggtggggtgggcaagggagagagagatggagagagggtgagtgttgccaagtatcctgaggagacagggatgaggggacaaacacattgtgttcagataatggaaatacagtgaaaggttcatgcgttcctgttcatacatttcatttgacttatgtcttacagtttggaaataattttgatagtctaattttacaattaggagagatggagagagattatctctattttacagatgagaaaactgagccccagagagggacagtaacttgctaagatcacatagcaagtggaaaaagcacaataagaacccaggctttcagactcaaatcctgtgttctcttttcatccccctttagtttcatctttcctactgccaagggtagggaagctgtcagggacagaaggttggaatgggaccccaggacaagactgagcagagatttga

SEQ ID NO: 1070 - DNA, 700 bp, Homo sapiens
agccccagagagggacagtaacttgctaagatcacatagcaagtggaaaaagcacaataagaacccaggctttcagactcaaatcctgtgttctcttttcatccccctttagtttcatctttcctactgccaagggtagggaagctgtcagggacagaaggttggaatgggaccccaggacaagactgagcagagatttgaatgtggggctgaatgtaggggagctcagaaggctcctgggtggccccgagtgttagggagatcatccgagttagggagatcattccagtgcagaggcaccatcttccccatctacctgggcaaggcaaggaggcccaaggggaggttggggcaacaatagtctggtcctggactatgaaatcacaacccgatacagggaaggaagacccagaagaccaggtgggaaagaaaagggctggctccgaattaataagagcctacaggagcctatgtgttctgctggggatcacagaatgttctacatcttagaatgtgattcatcaaaagccattacaataaaaatgttgggtacttaaacatggcttagctttatttcactgatttggagtatagcacccctagtcataataagcatattcttacaggcttcaaaataaagtaagaatccctaaggttaaaaaaaaaaaaaaggtcaaagatgtaaatgtaaatgacagtt

SEQ ID NO: 1071 - DNA, 700 bp, Homo sapiens
ctacatcttagaatgtgattcatcaaaagccattacaataaaaatgttgggtacttaaacatggcttagctttatttcactgatttggagtatagcacccctagtcataataagcatattcttacaggcttcaaaataaagtaagaatccctaaggttaaaaaaaaaaaaaaggtcaaagatgtaaatgtaaatgacagtttcattggtaaatcctaactggggaatttctcctaagcaaaaaattattgatatgcacaaagatttagctaatagtgttgtttgtattacgaaaaaatggaaataacctaactgtcctacaataggggattaattgggtaaatttttatttatccttgtgaaagaataatgtatacctattacaaatgacattgcataagtacatttcatgacatggaaagatgctcattatggctaaatatacatatgcatatacgggtatatttatacctgtatctgtgaattaaaattaagtttttgttttaaagcattttttatagtgtcctgttgccttcacagggtcactgtggtcaacttatcagaccacaaagatgcaaacttcctttccctaatctcatcctgaattttccagtggatgtgtcaggttctcaggggaaggacaagcatctatttgctgtaccaagaaaggatcccacgactcaggggtcacttgttttctc

SEQ ID NO: 1072 - DNA, 700 bp, Homo sapiens
gttttaaagcattttttatagtgtcctgttgccttcacagggtcactgtggtcaacttatcagaccacaaagatgcaaacttcctttccctaatctcatcctgaattttccagtggatgtgtcaggttctcaggggaaggacaagcatctatttgctgtaccaagaaaggatcccacgactcaggggtcacttgttttctcttattcttgctcagaaggtcttggtccctgtagcaagtccccacttccatttgtcacttaaagtaccccaaaacccacctttccattccagagtgtcattgccctccactttgcttaacactcagttaggttccttcctcagtttctcctacctcctttcctctcctagctcctgacccacctctatctggtagacagttttgcccattcctgctggtatcctgggaaccaggtttggcattggtcacagcactcagattgcaatgcgccagaatgggattaacccatgcatttcctctacgggagggaggtagagtgactggcaagtcgaatgttgcatgggtgtgtctatttatagcctgcaaaatggggtgctgccctggagggagagctgcggtgaaggaaatgacacgcctgggagagtaacttacttctgcaggagctctagggagatgaaggaagaagcctcctgggccagagttttggatggaaaatgaac

SEQ ID NO: 1073 - DNA, 700 bp, Homo sapiens
tacgggagggaggtagagtgactggcaagtcgaatgttgcatgggtgtgtctatttatagcctgcaaaatggggtgctgccctggagggagagctgcggtgaaggaaatgacacgcctgggagagtaacttacttctgcaggagctctagggagatgaaggaagaagcctcctgggccagagttttggatggaaaatgaacacccagtcaagtctctaggactatacgtggggcggggactagttgtgcgcgagagttaagtaggggcccttaccaaggagcatgggacctgggctccccaaccctttggctagccccatggcgttgatcagccctgagctaattcctccatgctgcccagaacctctctgggccaagccctggggactcagagatgacagcaatgcttccattgcggaactcccatacgcgggccacagggaggctctggaggcggcctgaggcaagagtgctaggagggatcagagctagcccacccctaccctcactcagccgtctgggcttctctgaaccccttctcctcctctgttccctaaagccagccagggggagtcccagggaggcagaccgaaaaggggtggggtgtcatcctggtcactattagaccctgcaacggcgaccttgaaaactactcagcgtctgttgcccgagtggagcatagtgctttacaatctcttcc

SEQ ID NO: 1074 - DNA, 700 bp, Homo sapiens
ctaccctcactcagccgtctgggcttctctgaaccccttctcctcctctgttccctaaagccagccagggggagtcccagggaggcagaccgaaaaggggtggggtgtcatcctggtcactattagaccctgcaacggcgaccttgaaaactactcagcgtctgttgcccgagtggagcatagtgctttacaatctcttcccatcacagcaaaccatcaaggtagggctactgttattttatggttgaaaaacagaggtcctgcgtcccttgggggctgtgccagcagcggccaagttgggatttcccctggtccagcagccccagacagcacacggggcagggtaggctttctgcctccttcacttccccagggcaggtgagtgacctggagggagggggtcacccctaaaaacaggggtagtgctaggactgaaaccctcccttcttgatatcccactggcaagcttgaggagccaggctgccagtcgggagattcggcccagtgttcccactggagagggcggcaagtgcccgggcgatcacctcgcctgcgttcgggagatatacctccgcccccgccccgccaggagggtgaaaagatggccccaggagccagccggctgggacaaggcggagtgagaggacaggctggggccgggggcgctgggctgtcccgggcagccctcctccgggcaagc

SEQ ID NO: 1075 - DNA, 700 bp, Homo sapiens
gcccagtgttcccactggagagggcggcaagtgcccgggcgatcacctcgcctgcgttcgggagatatacctccgcccccgccccgccaggagggtgaaaagatggccccaggagccagccggctgggacaaggcggagtgagaggacaggctggggccgggggcgctgggctgtcccgggcagccctcctccgggcaagccggagcaggggtggattgggagcgctcggggcgggcccgcggtggccccggggcggtggcgcccggccggagagggtggggcggagcagccgccctgtacttccccttcgccgctagctctacaacagcctgatttccccgaaatgacggcacgcagccggccaatgggcgcccgcgcggctgtccgggggcggggccggccagggctggggaatcccgctaagtgtttggattgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagaggtgagtacgcct

SEQ ID NO: 1076 - DNA, 700 bp, Homo sapiens
agccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagaggtgagtacgcctttgaggcgcggggcaccggcggcgtcgaataaaaggcgcgcggggcaccaggaagtggggggtcgaaagctccaggctggagactcgccggcgcgcggcgttgcccgggcctccgcgcgggctccggggggcgccggaggagctgcgagccgcgggccgcggcgcggggagggcgggacgcggcgtggaccgcccacccggacgaggctgccggcgcccggcagctttcgcagatctgcgtgcgcgcagccgccaggggcctgtaggtggcccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccac

SEQ ID NO: 1077 - DNA, 700 bp, Homo sapiens
cgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccacttctccagaggaggggaaaccgggccggaagggttagcgtcctggtcttagcgttgtgggcgctgtggctgtcaggaaggcgtagaatggattcaggggggcgggagggggctgttcagggtgacggctagccctttgctagctagtggttacaactcaagtcaagggaatttcttcttggcatcaagcaaaagaagtccctcccttcccaaaggatttgaattttgagcgaaaagttctgaaattagggtatctgtgcattttgtctcttttcctgcatatgaatcctgaagccatcacttgcatgcctgtctcctccagagactggctgggaggggctgaaggaaggggcaaaagcatttttgcctaagatgctgaaaaaatttggagagcagttttattccagcgcagctcccctccgcactgagtgtagtacctagcagctggctgaggtgaggggagggtaactaagtgacctcgggtggggcaggtcactgcc

SEQ ID NO: 1078 - DNA, 700 bp, Homo sapiens
acttgcatgcctgtctcctccagagactggctgggaggggctgaaggaaggggcaaaagcatttttgcctaagatgctgaaaaaatttggagagcagttttattccagcgcagctcccctccgcactgagtgtagtacctagcagctggctgaggtgaggggagggtaactaagtgacctcgggtggggcaggtcactgcccaggtactgttcaacagattccagactggagcctctgtgttctctttacagccaacatgcccatcactcggatgcgcatgagaccctggctagagatgcagattaattccaaccaaatcccggggctcatctggattaataaagtgagtgtaactctttgggttttcctgccactgttttaacccatgtacttctggagggaccaaagcttcagatgcagctcaaaaagggaagtgataacgggacaagcaggtgtttctcccagtgggtcctgcatgcagggagtgtgcacggcccagcctgggcctcacttgcatgactcctgccttcttcccttcttgaggtagggcacccacctgaaggcacttccagtttccagcagcaagactttccagcatctgcagagctggagttctgctctcctctaagcgagacccttacaaacatacacagcactctgcagggctccaatcgaacaaatagaagactgagaagtgga

SEQ ID NO: 1079 - DNA, 700 bp, Homo sapiens
gcctgggcctcacttgcatgactcctgccttcttcccttcttgaggtagggcacccacctgaaggcacttccagtttccagcagcaagactttccagcatctgcagagctggagttctgctctcctctaagcgagacccttacaaacatacacagcactctgcagggctccaatcgaacaaatagaagactgagaagtggatgctgctgggcagaaacgtgcctggcttagcagaggacaaacgagttaatcttgcaccagtcactctggcccaagaagcctatagctggtgcacttggggcaacatagaccctatagacttagtagcaatgatagtattcataataatagctaatgcttactgaacactccctgtgtgcctggcacctgctaagtatgttatttacattgtgtcatttaatcctcgcagtagtcctgtgggttagatcttactaatgtcatcattttcagataagtaaacagaggcactgagaggtagatcataagatcacacaaaaagtgatgaagccaagatttgaacttgaacggtctgactcagaaatctttactgttaaccataagtgatataataacagtaagaccttagacttcatatttgtcactgtgtccctacacatcctctggtttttaatcctcaaaattttgttggatatgttttctcatttccgagaagagaaaa

SEQ ID NO: 1080 - DNA, 700 bp, Homo sapiens
atcataagatcacacaaaaagtgatgaagccaagatttgaacttgaacggtctgactcagaaatctttactgttaaccataagtgatataataacagtaagaccttagacttcatatttgtcactgtgtccctacacatcctctggtttttaatcctcaaaattttgttggatatgttttctcatttccgagaagagaaaactgaggggcaaagagatacagtgacaatgccagggttacacagtgttcaccatccaagtctagcccagagctccctcagtggtatgaccaggaccccctgtgtaagagcccatgctcccaggtgtcctgaggagtcctttctaatggaagaagttcttacttccatgtgggtgcttacaagccagagagaaacatcccagagcttcaaaaccagggctttgggggagggtgccctgtgtgggtcctagcacatgtgtaacaggcagagggaggtctttgtgagctaataatgctgcagctcatccaaactaggtgtccctcctgagagatccagagtggtctgtttaagccagcctcaagatgggtgtccaagccagatgtcaggggaaaaaaggggaagtcagccttttctcagacctgtctggctgggcaggcctgggtctcagactcagccccaaagtctgtggtctctgacctgacacagccttatgtgtatgtg

SEQ ID NO: 1081 - DNA, 700 bp, Homo sapiens
ctcatccaaactaggtgtccctcctgagagatccagagtggtctgtttaagccagcctcaagatgggtgtccaagccagatgtcaggggaaaaaaggggaagtcagccttttctcagacctgtctggctgggcaggcctgggtctcagactcagccccaaagtctgtggtctctgacctgacacagccttatgtgtatgtgtgtattgttcaggaggagatgatcttccagatcccatggaagcatgctgccaagcatggctgggacatcaacaaggatgcctgtttgttccggagctgggccattcacacaggtgtgtgcctgggactcaggcctaggaagcccagggtagagacaagaggaggcactcacgttaacacagaggctcttcactggggtccctgagctccctgagacaacatgcagaattactgggaagaggggctggtggcagacttgtgtttctggagaagagagtcgatcatctcagcaaattctcaaagggaaaagccaagatcttagaaagtgtgtggcttcagggggtttgtggctagatgaaagttctccctggcaaaagcatctgtgaaaagcagctgtaagccagggcactgaaagagacccaggtctgcctttttcttcgtgttgaccaaggcccttggtccaagcctcatgtggttggtggcctcctttatccttgaga

SEQ ID NO: 1082 - DNA, 700 bp, Homo sapiens
aaagggaaaagccaagatcttagaaagtgtgtggcttcagggggtttgtggctagatgaaagttctccctggcaaaagcatctgtgaaaagcagctgtaagccagggcactgaaagagacccaggtctgcctttttcttcgtgttgaccaaggcccttggtccaagcctcatgtggttggtggcctcctttatccttgagagatggagctctaggcccatctcagaacagtcagcccacccatttagtaactgttctctgctgcccagtctgtgcccactctaccctctggctgctgatagcccaaggaggaagactgggcatagtctgagacacagatagtacactttggggatatggggactctagtgcttctggctgggcccttcactgaggcccgctagatgtgtttaagccaagcctgggcatttgagaaggcccagggcctaggacctgcagagtgtcaccgggagtacctgctggtttgaccactgtggctctctggtagcataagaggtcaggggtaccttgccttcctccttcaggccaggggcagctgaggatccctacccatggccctgacgatcctcttttttctcctgccctctaggccgatacaaagcaggggaaaaggagccagatcccaagacgtggaaggccaactttcgctgtgccatgaactccctgccagatatcgagga

SEQ ID NO: 1083 - DNA, 700 bp, Homo sapiens
tctggtagcataagaggtcaggggtaccttgccttcctccttcaggccaggggcagctgaggatccctacccatggccctgacgatcctcttttttctcctgccctctaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaaggtatccaaggactctgggtccttgggaagccctcagggagggagggtagaaggaggtcagctggggctggagagcctgcaccaaggctgacagcccgtctgccccacagaaagaaagtcgaagtccagccgagatgctaagagcaaggccaagaggaaggtgagtgtggtcctaagcagccaggcctttggtcacctgtgggccagggtgagcagtggaagaaatgctaaggtgggcctgggcctaagctgctttctccctcgacagtcatgtggggattccagccctgataccttctctgatggactcagcagctccactctgcctgatgaccacagcagctacacagttccaggctacatgcaggacttggaggtggagcaggccctgactccaggtgagctggtccaggt

SEQ ID NO: 1084 - DNA, 700 bp, Homo sapiens
cagtggaagaaatgctaaggtgggcctgggcctaagctgctttctccctcgacagtcatgtggggattccagccctgataccttctctgatggactcagcagctccactctgcctgatgaccacagcagctacacagttccaggctacatgcaggacttggaggtggagcaggccctgactccaggtgagctggtccaggtctggcaggagaccccacaggtcagtgggatgactctttctcttggaggcatggtgctggcacatggtggcccattagtgcaggctgcagggttggtcggagggcgctcgatgtcttgcaaactaagaaagcacacaaccttgacctgtggcttctgctgttccccagcactgtcgccatgtgctgtcagcagcactctccccgactggcacatcccagtggaagttgtgccggacagcaccagtgatctgtacaacttccaggtgtcacccatgccctccacctctgaaggttggtgctcctggggcctggcctgcctgcttgactgtctgggtcctgtgaagggcttcctgagagagaaaagatgatcagaactccacctggcactgaattgattgagttgggcattgcccagtcttagccaccatagggggaggcaagcgacggggacactaggaaggcagttcagagtgggctgcagtacagtgggggctggtgag

SEQ ID NO: 1085 - DNA, 700 bp, Homo sapiens
tcctggggcctggcctgcctgcttgactgtctgggtcctgtgaagggcttcctgagagagaaaagatgatcagaactccacctggcactgaattgattgagttgggcattgcccagtcttagccaccatagggggaggcaagcgacggggacactaggaaggcagttcagagtgggctgcagtacagtgggggctggtgagaggagggaagggggccaggggctgcattttggggtgctggttctccttcctcctctgtagcccagcatctgagggtgaggaaggaagtagggtaggggtgggaagcggcgtggcttcagggtttgagaggctgagtcaccaggccagggtcctgttctggaatctctatggcagataggtccaccgggagggtgtgtgtgtgtgtgtgtgtgtcagagagacagagagacagagaaagggcagggggatctggtgggctggaactggaactgcagggtgagtgtggctgactgccagccaacctctctgctttccccatccacagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcc

SEQ ID NO: 1086 - DNA, 700 bp, Homo sapiens
caacctctctgctttccccatccacagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcccacaagtgccacattcacgtggcttgactggtgggaaagccaccatgggaagggaaggcaggtgggaggcctggcctctgacaggccgtcctgaagcaagccttggggcatcagacagctctgtgagtcaggcactatcagcgatgggtccctggcctgcatcctctgccccaacatgccccagccctgctagttcgggaaatgcacatcaggcttcaataatcagcctttaggatccgttaatatgatgatggctttatagaaaaagttagcaaattatcctccaggtttttttttctgcttcagttttgaaagtgaatatagtttttgcagccgggggcagtggctcatgcctgtaatcccagcactttggaaggcgaaggtgggtggatcacctgaggtcaggagtttgagaccagcctgactaacatggtgaaacccatctctaccaaaaatataaaaattagctgggcctggtggcgcatgcctgtaatcccag

SEQ ID NO: 1087 - DNA, 700 bp, Homo sapiens
tgcttcagttttgaaagtgaatatagtttttgcagccgggggcagtggctcatgcctgtaatcccagcactttggaaggcgaaggtgggtggatcacctgaggtcaggagtttgagaccagcctgactaacatggtgaaacccatctctaccaaaaatataaaaattagctgggcctggtggcgcatgcctgtaatcccagctactctgaaggctgaggcaggagaatcgcttgaacctgagaggcggaggttgcagtgagctgagattgtgtcattgcactccagcctgggcaacaagagcaaaactccatttcaaaaaaaagtttttgcagtagttgtacgccagctgttccattagcccaaaaaattgagacatggatgtcgttccttatctctagcttttctagtcatcttttcttgatttattatgctaacctttgttttaagccacattccctcttactatgtccttacacagttgagagggaagtcgtggagatgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtga

SEQ ID NO: 1088 - DNA, 700 bp, Homo sapiens
atgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtgagtctgcactggaagggagttgatagcctcttgctcttctgtccccagctcttggagcagtcggagtggcagccaacaaacgtggatgggaaggggtacctactcaatgaacctggagtccagcccacctctgtctatggagactttagctgtaaggaggagccagaaattgacagcccagggggtaagaaggccctggatccttatggcttcttagatgagggagaaccacgtagggatggagaaagcttgggggcagggccagggagcagggcggtaaagcatctggggtactgacacattgtgaattagctacggctgccatgccttaaggtttgcctgaagctgagtggatgtttactgctgtgctgggaagagcagaggccatgtctatggccttcaggggtagggggaagcacacctgatgccaccgtcccctaccctcatacaaccttcttcacatcttctaggggatattgggctgagtctacagcgtgtct

SEQ ID NO: 1089 - DNA, 700 bp, Homo sapiens
cattgtgaattagctacggctgccatgccttaaggtttgcctgaagctgagtggatgtttactgctgtgctgggaagagcagaggccatgtctatggccttcaggggtagggggaagcacacctgatgccaccgtcccctaccctcatacaaccttcttcacatcttctaggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaaga

SEQ ID NO: 1090 - DNA, 700 bp, Homo sapiens
gctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgta

SEQ ID NO: 1091 - DNA, 700 bp, Homo sapiens
cccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaa

SEQ ID NO: 1092 - DNA, 700 bp, Homo sapiens
aacctgggaggtggaggttgcagtgagccgagaacatgccattgcactccagcccgggcaccaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgt

SEQ ID NO: 1093 - DNA, 700 bp, Homo sapiens
agactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcacatgtggtcagtggttaccatattgaacagtgcaggtagatactggactgggggcagatc

SEQ ID NO: 1094 - DNA, 700 bp, Homo sapiens
tgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcacatgtggtcagtggttaccatattgaacagtgcaggtagatactggactgggggcagatctgagggagaggggtttgagtagtgggaggacactggggataggggcttggggctatttacctgccattttgagtagtttgctattttagcagccaacaataactattggtgctgaataccagccctgcagtgtagcatgagacaggtccatgcacacatgcattaggaaaacaccttcatgaagcaggattctgcctgggctgatgcacacaacctctatggagggtaaacagtgtttctgaagaccgtagtttgggaacccctgacatatgacaatgcccccttagataagctcaagttacaggaatgtctgagggtggaaggtgtggatatgtgcttttcctgtctccctcttcagtgtctggccatggggcataaacactacccagcagtaggtaggctggccaagagaagccagcttgcatcaccagcatcatctagggaatggaatcatggcagtaatacgttgcttaggaaacaaaagctctatggacacatc

SEQ ID NO: 1095 - DNA, 700 bp, Homo sapiens
ttacaggaatgtctgagggtggaaggtgtggatatgtgcttttcctgtctccctcttcagtgtctggccatggggcataaacactacccagcagtaggtaggctggccaagagaagccagcttgcatcaccagcatcatctagggaatggaatcatggcagtaatacgttgcttaggaaacaaaagctctatggacacatcttccaccttctcagtcccagaaaccatatgtactgtgaccccgctcactaggcccagccctcgggaagagtgtgggcccttgaaaagggaagactgagtgagaaaatgatgagaaaactacaaaatgggcagaggtcagtctgacacattcattctctgtcaagctcaggaagtactggtccctgatcttggagatgctgtgtgagtggcagggggactcctgctgggtaaatattctatatgtggatgcctggacaggcccctatcccaggccctgcttgtcagaagctccccttgggccgagcgcggtggctcacacttgtaatcttggcactttgggaggccgaggcaggtggattgcctgagttcaggagttcaaaaccaggctgggcaacatggtgaaaccctgtctctactaaaaaaaaactaaccaggcgtggtggtgcatgcctgtaattccagctactagggaggctgaggcaggccaatcacttgaacc

SEQ ID NO: 1096 - DNA, 700 bp, Homo sapiens
gccgagcgcggtggctcacacttgtaatcttggcactttgggaggccgaggcaggtggattgcctgagttcaggagttcaaaaccaggctgggcaacatggtgaaaccctgtctctactaaaaaaaaactaaccaggcgtggtggtgcatgcctgtaattccagctactagggaggctgaggcaggccaatcacttgaacccaggaggtggaggttgcagtgagctgagatcacgccactgcactctagcctgggcaacagagcgagactctgtctcaaaaaaaaaaaaaaaaagaagttctacttggaagctccacttggatttctcaagaatagcttcacctgggaacagaggaatagacaggatggacttttccagctccttcagggaccagccctttttaagatttggattgaggtggctagccacctgtggcttccatctgggttctcctagtgggtgatggcaggtggtgcagagcaaggtagagtggactgacgggaggaaagtgataccacccagaacaagcagcagctctgacttctttttctcctgcccttcaatctaatccctgatggagggtaggcagtgagtatgtgaagtcttaggcagctgtggaaatctctcaagttctaaaagcaaagttaattgcttgtaaattaccaaaaagagagaggaattatgtccatcagcttccaa

SEQ ID NO: 1097 - DNA, 700 bp, Homo sapiens
cgggaggaaagtgataccacccagaacaagcagcagctctgacttctttttctcctgcccttcaatctaatccctgatggagggtaggcagtgagtatgtgaagtcttaggcagctgtggaaatctctcaagttctaaaagcaaagttaattgcttgtaaattaccaaaaagagagaggaattatgtccatcagcttccaatctccacaaccaagatggagtcctcaatttccccatcccctctgatcccaggagtcctaaatgattggtagcaattgcttggaatctccagggagggacctcaaaactctcccctggcccccatcacaatggagctgggtcctagggaccaagcctggagtagtgtgggatagagccagacctttcaggatggagagctgtcccatcacatcctaccaagacttcagccttttcctaggaaaagaaactaaataaggtctgacagctcacctaaaggtgatggcagctgacactaccgagtcattagccaaacagtgcctgaaacggagcagtattagtaagatctgaaccaagtttgtgcttaataattagatcattctaaggacctgacagtgcttctgtgggtcattctcaagagtttcagtataagcactaatggtggaagttctaggttgagggagctaggaggttgttgaaagatctgttttgctggggttgt

SEQ ID NO: 1098 - DNA, 700 bp, Homo sapiens
agtcattagccaaacagtgcctgaaacggagcagtattagtaagatctgaaccaagtttgtgcttaataattagatcattctaaggacctgacagtgcttctgtgggtcattctcaagagtttcagtataagcactaatggtggaagttctaggttgagggagctaggaggttgttgaaagatctgttttgctggggttgtgatgagataactgtcatcaaggaccactttccactggggtaaactgacaaaagtggtgctcagccacaccagctagatttctcatgttgggccaagtttacagacatttgcgggcatttgtggttagtcatgggtttccttgccttaactccaaaagggtatagctggctggtcactttcattgggctggtttattcattcagctcacttggcaataggaagaaagctagaagctaataggcaaaccatcccttcttggtgtgtcagctttcaacatctctcagtgcactgtgtgcagggtgttgtgaccattacaactccaaaggaaagagctttctctgatttttctggaagtctccagtggggcctgccaaagtgggaactgaaatcctggggtagccctgggaagtggagtttttttctctaggagtgatgtctcctggttggtggggctgggaaacagccaggttgtcattctctgggaccacttgatctttca

SEQ ID NO: 1099 - DNA, 700 bp, Homo sapiens
ggtgttgtgaccattacaactccaaaggaaagagctttctctgatttttctggaagtctccagtggggcctgccaaagtgggaactgaaatcctggggtagccctgggaagtggagtttttttctctaggagtgatgtctcctggttggtggggctgggaaacagccaggttgtcattctctgggaccacttgatctttcacactgtgtacagatccaaaactctgcccttatacttggaggggaaagggggtacagatgtcctccaggcagtcctgttggagcacccagggctaatatagtgaccctatagaaagcttttgtctctgtcagatgtaatgctgttccttaacttgggcacaactgatcttccaattcatcagaactcagcactaacctttccccagttctgctggctgtcacagaggaaggaggcctggggtgggagaaggggaagctggtgccctccttttccaggggtgaaagtacttggcagggtggagcttggctttatcatccggagctcccttgtggggccaagtctaaggcctcagaagggtatagctggctggccgcatagttttcctagctccaggcagctctcaagagacccatttatgctggttttctcagggtaaggagttacagaagtccacctctgctggctcagtggtaagacacaagcctgcagagtctgctga

SEQ ID NO: 1100 - DNA, 700 bp, Homo sapiens
gagcttggctttatcatccggagctcccttgtggggccaagtctaaggcctcagaagggtatagctggctggccgcatagttttcctagctccaggcagctctcaagagacccatttatgctggttttctcagggtaaggagttacagaagtccacctctgctggctcagtggtaagacacaagcctgcagagtctgctgagtgaaacttcagctggggagatactggaggctatggagcaaggacatggggactgaatgaaagaggggaggcagacgtccagcccaccattcctcacccaaggagatgatcccacaagctcacaaatgagcagaactggaaaagacctcaaagtgtggctggataatggcaacacaggcctcgagtgctcactttgtgctgggtgctatgccaagcaccacgtgtgtaccacggcactggcaccccaccacggcccttgttcacagaccaggaaaccaactctcaccacctaatcagtatggagccttggttccaacccacatcatctatctgtgcccagaatccaggttggttccatatcaggctgcctgagagaagaacacggaggcctgcacaagaagctggggagagctagcaaggggcagggcccgagcaccttatgccaagcaagcacttgtggatgctgagggaaggcggcaaaagctgcagctgctgtgct

SEQ ID NO: 1101 - DNA, 700 bp, Homo sapiens
atggagccttggttccaacccacatcatctatctgtgcccagaatccaggttggttccatatcaggctgcctgagagaagaacacggaggcctgcacaagaagctggggagagctagcaaggggcagggcccgagcaccttatgccaagcaagcacttgtggatgctgagggaaggcggcaaaagctgcagctgctgtgctgccctgccttcagctctcctcccttcccccagcacacacaccttccaacacccctggcaacatggctctgccgctacaggccccagggccccaacagggtagggtttgccccacctatgccctggaggccacctgcagtttcgaagggtggggccccagggggccgagacacagacaggcttgtaacttggcctcagtgcagggggcagcttggccacaccaggcctgtttggagcaaacgggggactctggcctgctaggccttatctcagctcccaggatcaaagaggactttttagccatgtttctgtctcagcaagacaacctagtctcctgttctgctttaaaccagaccctctgttgggtcctggagttcctcagaggtctggaccctggatggctgtgagactcaggaccatgcacagatgcattctcattcccagccaccaggctcgggtcagaccctatggctctggtgggcctaattcctggtttcttg

SEQ ID NO: 1102 - DNA, 700 bp, Homo sapiens
gccatgtttctgtctcagcaagacaacctagtctcctgttctgctttaaaccagaccctctgttgggtcctggagttcctcagaggtctggaccctggatggctgtgagactcaggaccatgcacagatgcattctcattcccagccaccaggctcgggtcagaccctatggctctggtgggcctaattcctggtttcttgatccctgagaacacctggcacctctggctgctggccagttgccaccttacatcaggcgggcgctgggattcacctgcaggcttcctttagggaaggccctcccctgccctcctgtgccagcccagaggggcagcctgggtgaggtcttcacatccatttcgggccaaatgccttggattggctggatcccctcctgtttctgccctccttctttccttcaaagcaacaaggttgtgggggtgtccagttctgctaccacctctccctcacactgtcaatctggaatttgtccagaattggggcccaagtagtgagttcttacacagtggttaaacaaacaaacaaacaaaaaccccacacaactcagctacaccttggctcagagaggccatgggatataccgaggatctcagatcaggagggaggcccctggagaggtgtggcggggatcatgtgcttctctggtttcttggagaaagctgactttgtgtaacaaggg

SEQ ID NO: 1103 - DNA, 700 bp, Homo sapiens
ggggcccaagtagtgagttcttacacagtggttaaacaaacaaacaaacaaaaaccccacacaactcagctacaccttggctcagagaggccatgggatataccgaggatctcagatcaggagggaggcccctggagaggtgtggcggggatcatgtgcttctctggtttcttggagaaagctgactttgtgtaacaagggaggcatatggacatggagttggtgtttggggatgtgggaaccattaggccagaattacaagaagtcctgtcatgtcggccacactagggcaacagtggactggggcaggggctgatgacctgattgtggaggcagtggagggctgtttctgctggggacccagggctcccctccaagtgctcctgcttggcttgttgggatggggagaggagctggagttgggatggggagaggagctggagttgggatgggtcacagcgaaggctacagcctggcattcccatatggggtaggggtggggtggggtgggacagggaggaggacctgaaggggtgtccaactttccgagacttggaacagcctggtgagtgttcatcaccattcttctgtcataggtggcgagcagccagagttctgggcacaggagaccatctacccccaagcttgtgcggcctgcctcaggtcactgaagaggaccccatttttggtctttggccat

SEQ ID NO: 1104 - DNA, 700 bp, Homo sapiens
gggtggggtgggacagggaggaggacctgaaggggtgtccaactttccgagacttggaacagcctggtgagtgttcatcaccattcttctgtcataggtggcgagcagccagagttctgggcacaggagaccatctacccccaagcttgtgcggcctgcctcaggtcactgaagaggaccccatttttggtctttggccatcctaagacttgtacaatggagccctggggccctcccttctctgaccagtgacagccctcacaggcaaagcctcaccctctagggcctgtcccttcctgtctgccagtccccacagggtctgcggggtacccaatctcgccaaccagactggaagctccccaggggcaagcagcttatctcttccatattctcacagtgttcagccaggattggcacttcagagcatctcctgctgctcagcagagatgtagttagcatctctctatagtagcactttctgagtccctcccctgggggaaccaggctagactctggggtccagaggagcaggcaggctgagaggcaaaaagggcacagaggaataaccaaccctgcccctgcagtagagccctgggcaaaacaggccatgaccaaccagcagccaaggtcaaagtccccagaacaagggccagtgtgtgcatgacatgcagcaggaccgcttgtctctttcggcagtact

SEQ ID NO: 1105 - DNA, 700 bp, Homo sapiens
accaggctagactctggggtccagaggagcaggcaggctgagaggcaaaaagggcacagaggaataaccaaccctgcccctgcagtagagccctgggcaaaacaggccatgaccaaccagcagccaaggtcaaagtccccagaacaagggccagtgtgtgcatgacatgcagcaggaccgcttgtctctttcggcagtactggagatagaaggctgagtcattaacaactttcttttattaaaaatgtacataagtaaaaggaacatggtttaattgtgcaaagagtaagaaatacagatgagcaaataacacgtattaaagccacctacgatataccacccagaagtaaccaggctgttgaatttttagagactggggtgcaaacacattttttcactcccttgtgcatatatctgggagctctgccatatacagacacagacgcggtgtccacaggcgatgcctctgctgggaatgctgcaagcaggagtctatcctttcctggtactggctcgggggccctcctcagcgcccaggtcactctagcatccaggagtccaaaggcccggctgtgcaggctgcagaggtgatctagagtagattaggaggtgcaaaaggcttggagataggctgaccaactgttccagtttgcttaggactgaggagtttcccaggatttgggactttcagtgctaaaac

SEQ ID NO: 1106 - DNA, 700 bp, Homo sapiens
ttcctggtactggctcgggggccctcctcagcgcccaggtcactctagcatccaggagtccaaaggcccggctgtgcaggctgcagaggtgatctagagtagattaggaggtgcaaaaggcttggagataggctgaccaactgttccagtttgcttaggactgaggagtttcccaggatttgggactttcagtgctaaaactgggaaagtcccaggcaaaccagggccagttggtcaccctccctgagggccaaaggctttgtcctgcccctcctgccctgtgctccccatctgccctcctgctggggttctggatcccccatccccacaccaagcagcccagggacagaggcctggctggggccttgcctcccgtggaagctcctgaaagttccagcctgaggcctagggagggacaggggaaagggaataaattaaggcagacagtctgtcatcacccaagaaaagggccaggtgaactgtggctgttaagggcagctagggatgtacaagcagaagggttccaatacttggctggccacccctccagccctggagctgagtgtgtggtccccagaggccccagagccagagaagtgcagggtgtctggattgaaaggcctcagctccctgggctcccagagccctggtgcctcaggccttaccttccccctcctccatctccacaccccctggcact

SEQ ID NO: 1107 - DNA, 700 bp, Homo sapiens
tagggatgtacaagcagaagggttccaatacttggctggccacccctccagccctggagctgagtgtgtggtccccagaggccccagagccagagaagtgcagggtgtctggattgaaaggcctcagctccctgggctcccagagccctggtgcctcaggccttaccttccccctcctccatctccacaccccctggcacttcctgctcagctcttctctacctaagactgggagcagaggatgaaggaagaggaatccaggacagaccgagctgaaagaggagcaggcaggtgggaggggacttgggtagaaaggacctctctgatagtggcaggaacatcctgactgtggtctggcccagccggctgtctatgcctgaggatgcctgaggatggggggcccttggaaaactcagaagagaggctaggtgtggaaggcagagtattggtccacagtggaataaagaggtccacgtcctaatgcatgagcctatgaatatgttgctacatggcaaagaggaattaaaactgcagatggaattaaggttgctaaccagctcacttgcaaatagagagattaccctggattattggtgtgggcccagtgtaatcacaagggttcttaaatgaagaaggaggaggcagaagggtcagaaccagagagatcgcattgtgaaaaacctgaccagccagtgctggc

SEQ ID NO: 1108 - DNA, 700 bp, Homo sapiens
tgttgctacatggcaaagaggaattaaaactgcagatggaattaaggttgctaaccagctcacttgcaaatagagagattaccctggattattggtgtgggcccagtgtaatcacaagggttcttaaatgaagaaggaggaggcagaagggtcagaaccagagagatcgcattgtgaaaaacctgaccagccagtgctggctttgaaagtggaggaaggggttgcaggccaaggaatgcaggcagcctctaaaagctggaaagggaaaggaaggaaagggattctccactagagcccccaggaagaaatgcagctctgttgacaccttgagtttagcccagtgagacctgttttggacttctgactacagaactataagaaaagaaacgggccaggtgcagtggcttacacctgtaatcctagcactttgggaggctgaggcaggcagattgcttgtgcccaggagtttgagaccagccagggcaacatagtgagaccctgtctctataaagtatacaaaaaattagccaggtgtggtagcacgtgcctttagtcctggctacttgggaggctgaggtaggaggatggcctgagcccaggagggagaggttgcagtgagtcaagattgagccactgcactccagcctgagtgacagagcaagaccctgtatccaaaaaaataaataaataaaaaattgtg

SEQ ID NO: 1109 - DNA, 700 bp, Homo sapiens
tgtctctataaagtatacaaaaaattagccaggtgtggtagcacgtgcctttagtcctggctacttgggaggctgaggtaggaggatggcctgagcccaggagggagaggttgcagtgagtcaagattgagccactgcactccagcctgagtgacagagcaagaccctgtatccaaaaaaataaataaataaaaaattgtgttgttttaagcccctgtttatgataatttgttagagcagcaataggaaactgatccactgggaaaccatttgggggatgcagctgcccaaaatccctgcacgtgggttggactcagcctcacaaggctctacagcctctctgtgaaagactccattccctctgggagaagctcagactctaaagccctgggcagggaatgggcctccatggcatggagggggtcaagaaggatgccccccaggatagtgcctctgctggacctctctataggaagcagctgcctctttgagccccctccccaaacctcagtgagctgaggtgctggctctgagtggtcatggaggggcttgcctgaggtcaggccacctaggacagctagtcagaggccacagggcttggcttaagattcccaggaaggagttgcatggcccctccacacatccgcaatactcataacactctcagtccttggccttactaagggaatactaaggggac

SEQ ID NO: 1110 - DNA, 700 bp, Homo sapiens
cccaaacctcagtgagctgaggtgctggctctgagtggtcatggaggggcttgcctgaggtcaggccacctaggacagctagtcagaggccacagggcttggcttaagattcccaggaaggagttgcatggcccctccacacatccgcaatactcataacactctcagtccttggccttactaagggaatactaaggggactcagtttagctctggaaaagctaggactactggaaaaaaaagtatagaggaaaaaaaatagttactggatgccagccagatctgcaaaaagtccccactctgccacttactagctatgtggcctcaaataagccactagaccttttgtagcctcagtttcttcatctgtaaaatgggtataacatcatttgtcttatctgtctcacagggtgtgtgagtctcaggtgagataacacacgagaaaacattgtgccgcacaacttgagatgcaaacagtaacgatcacaaccccacatgccttttgatagggtgaatgatcacagcatcctgtgttagggaggaaagggtgagcacagacgcttcaaaactctgtcttacccataggcagaagggtgtagcctggccaggggagaaaaggacccagccactgccaccgccccgcagctcacaccggatgtgcgacagagccaccatgcagccccacaggatgtcctccaac

SEQ ID NO: 1111 - DNA, 700 bp, Homo sapiens
cttttgatagggtgaatgatcacagcatcctgtgttagggaggaaagggtgagcacagacgcttcaaaactctgtcttacccataggcagaagggtgtagcctggccaggggagaaaaggacccagccactgccaccgccccgcagctcacaccggatgtgcgacagagccaccatgcagccccacaggatgtcctccaaccactacagactgtggggctttgctttttttttttttttttttttttttaagaaaaaggttttctagtttcttctacattaaaaacaatccctccttctcataaagcacaattttacagaggaaaagggagatgtgaaactatacacaattcaaatctaattaatatataatttttttgtggaatacagatggagggaatacatcacaatactaaaggtgattatctttggatggtgggattacaggtgattatatattttttatatttctatagtttaaaaatattccatgatgacctataattacttttacttattttttgagacaaaatctcaccctgttgaccaaggctggagcgcagtggtgcaatctcggcttagtgcaatctcggtgtagtctcgacctcacaggctcaagtgatcctcccacctcagcctccggagaagctgggactacaggtacataccaccatgcccagctaattttttgtagagacagg

SEQ ID NO: 1112 - DNA, 700 bp, Homo sapiens
ataattacttttacttattttttgagacaaaatctcaccctgttgaccaaggctggagcgcagtggtgcaatctcggcttagtgcaatctcggtgtagtctcgacctcacaggctcaagtgatcctcccacctcagcctccggagaagctgggactacaggtacataccaccatgcccagctaattttttgtagagacaggatttcgccatgttgtccatgctggtctcgaactcctgagctcacataatcctcctgcctcggcctcccaaagtactgggattataggtgtgagccaccttgactggcctataattacttttataatcagaaaaaaaattataaataaatatgaaaagtgccaggaactttcttttgtggagccacacactgggctcaaggaatcatttgagctgggttctgcaggggtgggagtcttggcgcgggccctggtccttgctgtgtgaccctggagactcactactttccctccctggcctttgtttgcctggtaagacaagatgctccctagggtcctttgcagcttaataagtaaagtattcgccttggtctcatccatcccagctctttgcccagcttccagtgactcctctgtgcctggagagaagggcaagcgccttactcatgccttgaggttgctgaccacttccgtcaccagcctcgctccttccagacctgcc

SEQ ID NO: 1113 - DNA, 700 bp, Homo sapiens
ttgtttgcctggtaagacaagatgctccctagggtcctttgcagcttaataagtaaagtattcgccttggtctcatccatcccagctctttgcccagcttccagtgactcctctgtgcctggagagaagggcaagcgccttactcatgccttgaggttgctgaccacttccgtcaccagcctcgctccttccagacctgccctgggagtccctgcctcctggccttcacctgcatcacggtctgcacttctcagagccctgcccttccttgaagaacaaagcctggccaaattgtgtcagccttctggcctgcagtgacccctgcttacattgtacataacaatagctataacttattgacattaacttcaggtcacatagcaaaagtgctctcatttaaatcttaggccaccagaggatccatagactaaaatgttaacagcatctcctggagttgtggagtgtggtgaccctatgtgatcctcctgtgccactgagagatatattattaacccagtttcactgataagataactgaggctcagagaggtcaagtaacttgcccatggtcacacagtgggtccatggcagagctgggaggtgatccctagtcagttccctccaagtccaggattttctcactcccacaatggtgtctcccttaatgactctcacattccagcctctgagggcaggaagg

SEQ ID NO: 1114 - DNA, 700 bp, Homo sapiens
gatatattattaacccagtttcactgataagataactgaggctcagagaggtcaagtaacttgcccatggtcacacagtgggtccatggcagagctgggaggtgatccctagtcagttccctccaagtccaggattttctcactcccacaatggtgtctcccttaatgactctcacattccagcctctgagggcaggaagggtatgttctgagttgaacacacagagagcactcaatgatgtctggtggtgaagatgttaatcatgagctcaatcaaggtttatcattaaatcaacaagtcttcctagtgtgtctgggagctctggggcccagggacaggcctactgtagttcagtgttgtattctggcacctggtggtttctggcacatagcccatgttcattaaatgacatgaattgattgtccattcaaataataaaacaataaataaataatactagctaacaggtatggagtgcctacaagccagccacctcagggagtttccaggacagttgaggagaaacataacactgttgacaagagctacaacgtagggttttacaccaaaacagtgtctacgtaaacagtgtctatcaaagagagaaaaatgatgggcagacaccctgatccttcccacagtgctaaaggccatgccagccactgtccccattacgacttgcatatactgactgccgaa

SEQ ID NO: 1115 - DNA, 700 bp, Homo sapiens
ggagtttccaggacagttgaggagaaacataacactgttgacaagagctacaacgtagggttttacaccaaaacagtgtctacgtaaacagtgtctatcaaagagagaaaaatgatgggcagacaccctgatccttcccacagtgctaaaggccatgccagccactgtccccattacgacttgcatatactgactgccgaagcacacaaacctgaattttccgtctgcatccatcgttctgtctgttcggatcacatctggatactactgttgcctctccagactggataaccagtctgctgagggccagaagatggtgagatggaaactagtcatgtttacttggagaagagaaatgaagaccgtctttaacacctgacaggttgctcttcccaagaggggccagagggcaacagccatggtcaacagctccaggcacccctgaggaagcctgctccagctggcagggttgtctggcaagggaccagtccctcctctggagaagtggtgagcccagtgggctgcctctccagcaggatcctgtagagaccttactctctacaatgcacactccacacacttgctcacttgacaaacacttattataactgtcaccctgggcccattccaggttagggacataaggatgaataaaacaaggtctgtaccagtagagaacatcagtcccctaggggagaaa

SEQ ID NO: 1116 - DNA, 700 bp, Homo sapiens
gagaagtggtgagcccagtgggctgcctctccagcaggatcctgtagagaccttactctctacaatgcacactccacacacttgctcacttgacaaacacttattataactgtcaccctgggcccattccaggttagggacataaggatgaataaaacaaggtctgtaccagtagagaacatcagtcccctaggggagaaagtcaggaaagcctcatcctgagccttcgactccttactgtccatcctctaggctcctgtctcagcttctgctgaaggctattttcttccttgtattctgcagtgaccaggcatatggcagataatcaacaaatacaggcatccctgaagagggtatcctgggataaaagccccagctggatcagtgctatacaggggccaactgggggtgggttccaggcagggtcatttgcaagggtccctctgccccttcaagtcctgccagacaggccttggccatggtttcttcctgcccctgtcccctgaccacagttgatctcccctggctgttatgaaatgtcaaagaatgtcctgcaatcctaaattccataatgatctttatcttctgttccctctgaggctcctcaatctgcagtaacagctgtggttcagcaagcagtgcggcactctggagtgctgttctgaaacagggccggcgtggggcagagctcatctgctgc

SEQ ID NO: 1117 - DNA, 700 bp, Homo sapiens
cccctgaccacagttgatctcccctggctgttatgaaatgtcaaagaatgtcctgcaatcctaaattccataatgatctttatcttctgttccctctgaggctcctcaatctgcagtaacagctgtggttcagcaagcagtgcggcactctggagtgctgttctgaaacagggccggcgtggggcagagctcatctgctgccctatccattcactgtgctgttcagggctagagaagattcatgtgtgtatatgctttttaaaaattgtgaaacaataattatgcagaaaaatacatagaatatatgttcagtttaacaaataatcataaagcaaatctctataaaaccactgctgctctgcagtgacacctgcttccccctaagtcgtgcataacaatagctacaatttactgaccatgaacttcaggtcacacagcaaaggtgttctcatttaatctttggccaccagaggctgcatagactaaaatgtgaacagtgtcccctgcagttgtggagtgtggtgaccctattggatcttctcacgccactgagggatatactgttttctgtagagaagtccagcagagtcactgtcctggggggcatccttcttgatcgcccccatgccatgaaggcccattccttgcccagggctctagagtctgagcttctccaagagggaatggagtctttcgcaga

SEQ ID NO: 1118 - DNA, 700 bp, Homo sapiens
tcccctgcagttgtggagtgtggtgaccctattggatcttctcacgccactgagggatatactgttttctgtagagaagtccagcagagtcactgtcctggggggcatccttcttgatcgcccccatgccatgaaggcccattccttgcccagggctctagagtctgagcttctccaagagggaatggagtctttcgcagaggggctgtggagcctcgtaaggctgaatctaaccacgagcagggattttgggcagctgcatatcccagatggtttcccagtggatcagcttcctgttgctgctctaataaactaacataaacttaggggcttaaaacaacacaaatttcttttcttatagttccgtaggtcagaagtccaaaacaggtctcactgggctaaactgaaggtgtcagcagggctgcattccttcctgggggctctagtagagaatctctttcctttcttcccctttccagcttttagaggctgcctgcattccttggcctgcggccccttcctccaccttcaaagccagcactggctggccaggtctttcatatattgcaatctctctgcttctgcttctgacccttctgcctctctcttctccatttaagaatgcttgtgattacattgggctcacccaccccagtttctacccaataatccagggtaatctcccaaacttaaagagaga

SEQ ID NO: 1119 - DNA, 700 bp, Homo sapiens
tccttggcctgcggccccttcctccaccttcaaagccagcactggctggccaggtctttcatatattgcaatctctctgcttctgcttctgacccttctgcctctctcttctccatttaagaatgcttgtgattacattgggctcacccaccccagtttctacccaataatccagggtaatctcccaaacttaaagagagaaaacaatactagcacccccaaagcacctacgtgttcccctactaatcacaaccccaaccctcccttctgcataagtagacatttgtaataattctgtgctttttgtagtttgacctcctctgcatgtatccttaacaatacagttttgccagctgttaaatttttgctaaaaggaattatactgtatgcattcttttgtaggttttattcattgatgagtcatttgttattacagtattattatccaatatgacaatattacagttattgcaagtcgctgtagttcatttcactccaggaacactgcacaatttatttgtactctccacttttgatggtcatttggacattttctggtgctgtgtgggtattctggtgcacatgggtaagagtgtggtttgagaagattctgaggagtgggactcttgggttacagggtatatatatgttttcatcttttaaaaaaatttatattattcatttttttaaagactagtca

SEQ ID NO: 1120 - DNA, 700 bp, Homo sapiens
gaacactgcacaatttatttgtactctccacttttgatggtcatttggacattttctggtgctgtgtgggtattctggtgcacatgggtaagagtgtggtttgagaagattctgaggagtgggactcttgggttacagggtatatatatgttttcatcttttaaaaaaatttatattattcatttttttaaagactagtcactgggcgcggtggctcacacctgtaatcccagcactttgggaggccgaggccggtggatcatgaggttgggagattgaaaccatcctggctaacacggtgaaatcccatctctattaaaaatacaaaaaattagccaggcgtggtggcaggcgcctgtagtcccagctactcaggaggctgaggcaagagaatggcgtgaacccgggaggaagagcttgcagtgagctgacatcgcgccactgcactccagcctgggtgacaaagcgagactccatctcaaaaaaaaaacaaaaaacaacaacaaaaaaagactagtcaagggcagtagtgagaagggggaaaagagtagaacaaggagttcgatctgtaactgactgtgaagtcaattgagataattcactaccttcagatcagccatgttttcatctttaccagatcacttatatgctttattttctttacttatatactttttaatcctgaaagtgtttctcaggg

SEQ ID NO: 1121 - DNA, 700 bp, Homo sapiens
acaacaaaaaaagactagtcaagggcagtagtgagaagggggaaaagagtagaacaaggagttcgatctgtaactgactgtgaagtcaattgagataattcactaccttcagatcagccatgttttcatctttaccagatcacttatatgctttattttctttacttatatactttttaatcctgaaagtgtttctcagggaaacagtggtattacacccagttgtttaggtagaagaaatggggtatgtctgcccttacagtgtgaccttcccaccttctgtcttcagaaccctgtcccctccaccccagatagccctgtgccctctggaatccacaggctggcccctcagtagcctccctaccttgcagttgggtggggggtgggaggaggtcaagaaagaggaagtgaaaaccaaatacaagggctacagagaagtccggtccacaaacctcaatgtttcagcagcacacgctgtgagaaaggaatgtgcaagctgtttgtggagcatgccttgggggtgccaaggccactggtgcaaaggtgtgcttctggacataagtcactccacacaatgctcaccccaaccctgtgaggtacggtactgtcatccccatgtcacagaatgaagacactgagctgcacggacattgagtgtctgtcaatacagtgcaatggttaatagcatgggatctaggtc

SEQ ID NO: 1122 - DNA, 700 bp, Homo sapiens
tttgtggagcatgccttgggggtgccaaggccactggtgcaaaggtgtgcttctggacataagtcactccacacaatgctcaccccaaccctgtgaggtacggtactgtcatccccatgtcacagaatgaagacactgagctgcacggacattgagtgtctgtcaatacagtgcaatggttaatagcatgggatctaggtctgtttaaattgggtttaaattctgacttccccacttactagtggtgcagtcacctgggccattactgacttcctttggtgtcagtttctgcacctgtaaaatggggctaattggctcacagggttgttgagagaggtaaaagatgtaatgtgtagaaggagcttagtcaagtgccaagcacaagggagaacccagtggaactaaaatgagcagagctatgaaatgatgaccattatagagttcaaggttgacagggtggaatggggggttgtcctggcaagctgggaccaggccaccaaggtgctggtttggtgctatgtgagaatggaatgctggccaggtggactctgaaacatggacacctggacagtcctcccactgaccttgtccacctttgtccggagctctctacctatctgtggctgcttccaaggacggtgatttctgacagaggcagctggaccttggcacatgcagaagtttcagctcagcatcagtg

SEQ ID NO: 1123 - DNA, 700 bp, Homo sapiens
aggtgctggtttggtgctatgtgagaatggaatgctggccaggtggactctgaaacatggacacctggacagtcctcccactgaccttgtccacctttgtccggagctctctacctatctgtggctgcttccaaggacggtgatttctgacagaggcagctggaccttggcacatgcagaagtttcagctcagcatcagtgctggccttcaggaggccgcattggcaggcggcagcagtgacagccaatgggcagcaaagcttgttgctaaggtcactgtgagccttatttggtgacacagggctgaccctgcattcacctctgagaaccctgggaaacgccaaccacagatgtgaaatatgaacatctcaaaaccacaactgcatttcctttgagaaaagattcggctgtcctcctctccagcctgcctccctccgctggatgtcttttgtacaatggctcactactgcaagaggcaagagcctaggctacaagaagagtctgctacaagctagtcctgggcaggcctggacagggagagggcaggggctgctgtgcaggcggccccaggaccttcaaggacctccaagacttccgttcacacccagcagctgccaacccctgcccaggcctcccccaacacagccggagggcctgttcctggccccacttcctgcagccttgggaagccggctagctt

SEQ ID NO: 1124 - DNA, 700 bp, Homo sapiens
gtctgctacaagctagtcctgggcaggcctggacagggagagggcaggggctgctgtgcaggcggccccaggaccttcaaggacctccaagacttccgttcacacccagcagctgccaacccctgcccaggcctcccccaacacagccggagggcctgttcctggccccacttcctgcagccttgggaagccggctagcttgagaaaggcgtgtggcactcatggaggaagtgggccggcactggggctctcaccatctgcaccagccacaccgcttcggtgcagcctggagctcaaacggttggcggtttcagtttttcacctccctttggtgcatcttccagcttatcattaaataagtaaaactgttgctccaccccagacaaatgtgggagggaagttgtgtcttcaatatttcccaaataacactcactgctccctcccattcatacagcaccttcgggtctgggagctgtgctcacatctgccatctcattacatccttgcaaccctggcaaaggtaatgactgagctcacaccatgtgtcagggacatgaatgaattcacagaattcactgtaattgtccccattttacagaagagaaaatgagacagagaaattcagtcattggctcaaggtcatcacataactaggattttctcccagatggctgagttccaaagtctgccctattctctt

SEQ ID NO: 1125 - DNA, 700 bp, Homo sapiens
atccttgcaaccctggcaaaggtaatgactgagctcacaccatgtgtcagggacatgaatgaattcacagaattcactgtaattgtccccattttacagaagagaaaatgagacagagaaattcagtcattggctcaaggtcatcacataactaggattttctcccagatggctgagttccaaagtctgccctattctcttctgctacattgcctccatggcacatacacaagaatgagttccatttactgatgagaaagtgaggctgaggtgaaagggtggtgtggggcctgaggtcagcgttgcttcctcagtccacatctcctcccagaggatggtccaccaacgtccttcatctgccctccccctttaaaaaccactgtcagcccggcacggtggctcatgcctgtaatcccagcactttgggaggctgaggtgggtggatcacctgaggttgggagttcgagactagcctgagcaacatggagaaaccccgtctctactaaaaacacaaaaattggctgggtgtgatggtgcatgcctgcaatcccagctactcgggaggctgaggcaggagaattacttgaacccaggaggcagaggttgcgatgagccgagatcacgccattgcactccagcctgggcaacaagagtgaaactccatctcaaaaaacaaacaaacaaacaaacaaaaacactg

SEQ ID NO: 1126 - DNA, 700 bp, Homo sapiens
ctactaaaaacacaaaaattggctgggtgtgatggtgcatgcctgcaatcccagctactcgggaggctgaggcaggagaattacttgaacccaggaggcagaggttgcgatgagccgagatcacgccattgcactccagcctgggcaacaagagtgaaactccatctcaaaaaacaaacaaacaaacaaacaaaaacactgtcatgcccccaccgccagcttgtctccctttctttttaggtgtggcccacagagctcagtgccctgcctatctggaagaggctgtgaagcccatctatgtaggtaacggaggcaaagcaagggctagggagagtgtgccatgtgggacacctccccctatcacctccccactgcctgcacacactggggacagtcaaagcattcctcaggctgggggtaggagctgtgggcggaagagctggggcatctgttcacagaatcctcccctgaagttgctcggaggggctgggatgcagtccagacactggggagcctgatgcagacgcctccctggagcactgtccttctcttgggctcttcaagcctgccctcactcatgaacacatattttttgtgtgtacttcctgcatgccaggcactacccaggcactgtggatgcacagtgaacaacacagaccaggtccacgcgtcacagactttacttccctgagggaggcag

SEQ ID NO: 1127 - DNA, 700 bp, Homo sapiens
cagacactggggagcctgatgcagacgcctccctggagcactgtccttctcttgggctcttcaagcctgccctcactcatgaacacatattttttgtgtgtacttcctgcatgccaggcactacccaggcactgtggatgcacagtgaacaacacagaccaggtccacgcgtcacagactttacttccctgagggaggcagacattaggcaaataatcacatggatctctgaaaaacatagctcctacgagagggtgcaacttcaggggtcttaacctacaaaggagtgtgtgggattagggggttagggcagctgttctaaggatgagacatttcaggtgaggagaggaatggggtggagttggcagtggggctggttctcggctctccccgactgccctccttccccgcattccagtcgcttcaggaaatctgccgcttccatgagagcttctttggtggtgtcttccaagctgctaccaagcgatggctttgccagctgttgctttcagtgtttgtgcctgggtgagcacagccggtatgaaatggcccagattaatcgagagccaggcccctcctaaagtacctctgaaaagagtttttcagcataagcatgacattagcttttcctagagaggaaaccacccccggggctgacagcaagcaggccaggcttaaaggaagcaagtgcagcgctggg

SEQ ID NO: 1128 - DNA, 700 bp, Homo sapiens
ctgttgctttcagtgtttgtgcctgggtgagcacagccggtatgaaatggcccagattaatcgagagccaggcccctcctaaagtacctctgaaaagagtttttcagcataagcatgacattagcttttcctagagaggaaaccacccccggggctgacagcaagcaggccaggcttaaaggaagcaagtgcagcgctggggcccctccatgccctgctgcagacaggacaccctcactgccttcccccaacatgctcccccactcccactcctgcttctttctccctgggggactctccttgtggaaaagaaaccccaacagtagggggagcgagtgaaactggaaaatgaaactgtgatttacagtttcattttccagtttcaatttagaagcagctctgccagctttccagtgcccgtgcctcagggcatcacagaggagctgaggggcaggaaaaagtgttccagccagcaagcaccctgctccctgggcaccctcagagggcgggtactggactggtagaacccactgagcagggagttgttgcaatgccgattcctggctctccaggctctgaggccgtacgtttgggccctttggtgattctgatgcaggctgtggacctcaccatggcagtcgtggcctcagagaccatcagaacagctagagcacacctgaggcacggcctcatcctctcc

SEQ ID NO: 1129 - DNA, 700 bp, Homo sapiens
cagagggcgggtactggactggtagaacccactgagcagggagttgttgcaatgccgattcctggctctccaggctctgaggccgtacgtttgggccctttggtgattctgatgcaggctgtggacctcaccatggcagtcgtggcctcagagaccatcagaacagctagagcacacctgaggcacggcctcatcctctccaagtcacttcctgccacagatgctcgggaagtgctgcttctctgtgcagcatctcctgccctcctccatctggtgttggaggcatcttagatgttctctgggacctgaggtctgtaggaaaccccggctgtggacttcacacaagggtcgctctttcccacactccaggtttccctttaagctgctaatttgtaacaggcattcatagaaacagaataagatagagaaattctattaaaggaacttatgtgcttttgctctgtctgttgctccatttatttgcaatttatagcctaatccaagaggatttaaggacaattaaatatttctttcccctcagtgtgtgtgtgcgagtgcacgtgtaagagtgtgtaggggttgggtcttccaatgtacctttgccctggtttgaccgtggggggagagggtgggcaggtctccaggcctgccagatgtagacctttcctaatgtctacagcaaatttgttcttcagtgttt

SEQ ID NO: 1130 - DNA, 700 bp, Homo sapiens
ccaagaggatttaaggacaattaaatatttctttcccctcagtgtgtgtgtgcgagtgcacgtgtaagagtgtgtaggggttgggtcttccaatgtacctttgccctggtttgaccgtggggggagagggtgggcaggtctccaggcctgccagatgtagacctttcctaatgtctacagcaaatttgttcttcagtgtttctagtatcagtttttgatcaatcattaatcaaagttgcaataaaaagataatcttctcaggactaggctataaaggtcctggctgcaaccttaaaaaacccttctgtggaggcctcagagccaagagaaaagggcgatgtgtctgtggctggatttggaggtaaatgaacgtgctgtccctctctaattggtgtgcacgaacatgaacttcagtcacttgcgtggctatggcctctttcttcatctctccctgccaacgaagctggtggtgccctggctcccaagccaggtggcaaagctggggaaggaggctgtagttgggcccaaatatgggggtctgggggcacctccacaggttgtgaccactgcagcatgctctggggccaggcctatggcagtggaggcaggacagcccccaggaccacagagcccccatagtggagggagccactacttgggcggctcagctcattcctgctgacttgctgctgtacagggc

SEQ ID NO: 1131 - DNA, 700 bp, Homo sapiens
ctggggaaggaggctgtagttgggcccaaatatgggggtctgggggcacctccacaggttgtgaccactgcagcatgctctggggccaggcctatggcagtggaggcaggacagcccccaggaccacagagcccccatagtggagggagccactacttgggcggctcagctcattcctgctgacttgctgctgtacagggcagaggggtgcctgagacaaagaggagacacacttctcccacgagaaataaagcaagcagctgttcctctcttgggcccagcaggggtcagaggctgtgggaccttcactccttccctctcagtggagagggcagatctgctctttggggtgtgagggcacagcctcctgacaagctggagaagcaggatttaagagctagaatcaacggagaatgtgaggcccagcatcaggttcaagaagcaaggggatcaaggttgggggggaggcagggagcctgagcctagcgcagcccagaccaacagactgaggagtccagagagccaacatgctcactcggccatcgctaagatgtgtagtgtgtgagaaggtgtgagaggtactcgcgtttctctctccaaccccttccaacatattattgggtcgtgggtgccatgtttttagtagacacataaaataaatgagtattttcagagaagtgcaaccctggaggtgcagggg

SEQ ID NO: 1132 - DNA, 700 bp, Homo sapiens
aacagactgaggagtccagagagccaacatgctcactcggccatcgctaagatgtgtagtgtgtgagaaggtgtgagaggtactcgcgtttctctctccaaccccttccaacatattattgggtcgtgggtgccatgtttttagtagacacataaaataaatgagtattttcagagaagtgcaaccctggaggtgcaggggagtgaactcagccatgagaaatcattcaaaggattgacctatggaacagggatagacttgctctccatggctccagcagggaagcagcagagaggggaacctttcctgaaagtccagtgtgacatctgaagacacacacacacacacacacacttttttgagagagagaacgagaatgaaaagatacacactgatctttcaacagtcgttgtctctacctggtgattgcgaatgattttaatttttttcctcttgtgcttacagtattttctaaaatctctaaaatacacccaaattactttcttgttatggcaaaatagacataaaatgtctacatccattttaaccatttttaagtgcagagttccatagtatgaagtacattctcactgttgtgcagccatcaccaccatccatctccagaactttttcatcaccctcaacataaactctgcatccactaagcagtatctccctgttcttcctccttccagcccct

SEQ ID NO: 1133 - DNA, 700 bp, Homo sapiens
ctttcttgttatggcaaaatagacataaaatgtctacatccattttaaccatttttaagtgcagagttccatagtatgaagtacattctcactgttgtgcagccatcaccaccatccatctccagaactttttcatcaccctcaacataaactctgcatccactaagcagtatctccctgttcttcctccttccagcccctggcaaccatccttctactttctgtctctatgaatttcactattctaggtacctcatataagtgggatcatctggtatttttccttctgtgtctggcttatttcacttagcataatgtttttaaggttcatctatgttataacatgtaccagaatttcattcctttttaaagctgaattatgttccattgtacgtattcaccatattttgtttatccactcctcttgtcatggacatctgggttgtttccaccttttggctattgtgaataatactgctacaaacactggtgtacaaatatcactttgagtccctgctttcaattcttttgggtatattcctagaagtggaactgcgggatcatatgataactaagtttttgaggaaccaccacattgttttcaacaaaggctgcatgattttacgttcccaatagcaatgcacaagggtatctatttcttcacatccttgccaacacttattttcaggttgtttttgtt

SEQ ID NO: 1134 - DNA, 700 bp, Homo sapiens
atcactttgagtccctgctttcaattcttttgggtatattcctagaagtggaactgcgggatcatatgataactaagtttttgaggaaccaccacattgttttcaacaaaggctgcatgattttacgttcccaatagcaatgcacaagggtatctatttcttcacatccttgccaacacttattttcaggttgtttttgttgttttaaaatagccatcctaacagatgtgaagtggtatcttacttattatggttttcatttgcatttccctaatctaaattacgttttaaaatccaatcctctctgaattgaaccctttgttctttatttctcaataaaatggaccttgccccctttttttccttctttgtacctatgctctgcattttaaaaaattgtggcaaaatacatataacttaaaactttaccatcttaaccattttcaagtgtagagttcagtattaagtatattcacattgttgtgccctaacccaaatatagtatataatggcaaaaagaaacaaaaggctctctaaagaaaaagaaagccgtgaattcttggaccccagagatgttcacaaacagattggatcaatctcagcagggactttcattcatcttctgagcatctctgctgggctgggctctgtgccaggcagggggctccgaggtgagtgtggcctggactctgcccttggg

SEQ ID NO: 1135 - DNA, 700 bp, Homo sapiens
tagtatataatggcaaaaagaaacaaaaggctctctaaagaaaaagaaagccgtgaattcttggaccccagagatgttcacaaacagattggatcaatctcagcagggactttcattcatcttctgagcatctctgctgggctgggctctgtgccaggcagggggctccgaggtgagtgtggcctggactctgcccttggggttcagcctctgtggggaacagttatacccaagggctgctgtgggcacagagggacaccctgttgtgtgggtgcggcattgggaaggggcataagtgaggtggcacatgagttcaggtgggaaggatgagcagacatgtacatgtgcagagaagggaactggcatgtgtggctgggctgtggcagcacacctcacaaccgccattacaggagcatctattaatcatttatgtctgtctctctacttgattataagctgcatgagagcagggctggtggttttgttcactgctgcattgctgccatgcccagcacaggcaagtgtaaaagaaacacttgctgaataaatgagtggttgatgacgaggaaaaaggagacatttctttccagaatcttggctgtaagcagcagacagcatggctgtactccacggggaaggcaggatggcaggaagcattatacaggtgatggagacaggagcacagcaggagccagtggag

SEQ ID NO: 1136 - DNA, 700 bp, Homo sapiens
ctgccatgcccagcacaggcaagtgtaaaagaaacacttgctgaataaatgagtggttgatgacgaggaaaaaggagacatttctttccagaatcttggctgtaagcagcagacagcatggctgtactccacggggaaggcaggatggcaggaagcattatacaggtgatggagacaggagcacagcaggagccagtggagaagaagagtttgaagattccctggttgagagaatggaagggcgtaattgctggggagaggtccctgaagaaaggggagaggctgggatgcaggctcagtggaaggagaggagtctccttatgagactcagatggccagtgtgaaaaagacagaagataccaactgctggtaagaatgggaagcacactgcatggggaactctcctatactgctggaggcgtgttcttcctgttattctagattcagacagcactctggtcgctggttggtgcaggccaccatttgggccaattagaggaaccccaatatctgcacttggactatcagaaatgagagctctacgcccagagcaatttccaagatgggcctgaatccatgagtcatggcactaaatggagcccagggttggctctgagcctaacagcctccaaaatgtcaactttgttcacgtgccactttgtccctcatctcatgccatgcagctggcaggacttcagtt

SEQ ID NO: 1137 - DNA, 700 bp, Homo sapiens
aaccccaatatctgcacttggactatcagaaatgagagctctacgcccagagcaatttccaagatgggcctgaatccatgagtcatggcactaaatggagcccagggttggctctgagcctaacagcctccaaaatgtcaactttgttcacgtgccactttgtccctcatctcatgccatgcagctggcaggacttcagttgacagaaggtagaccctgctcttttcaaaaagcacacaggacaggtgctgataggccagcccctcccactgagctctagttactgcggtgaacttcaccaggaggttcagcacccactgtggctctgcctgaggggcctctgtgcacactcagtccaggcactagcatcccagcgcccggccagtggtccaactccagactcactacacagagccccttgcaaccgatgtgtgccaacatggagcccacacagggcagctcagcgtgacacctgcacagctcaagactgagggaaggaaatgcatcttctttctcaagttggaagaggctgtactgaattaccaaatggcattatactctctgtgggggagcacagatgagtgtccggcagtccctgggatgatgttacagtccagaggtggggatgagatgagcccagatgatgcaatggggatgcaatcaagacacgatgtcattagaagccacagtgtgttctctc

SEQ ID NO: 1138 - DNA, 700 bp, Homo sapiens
aatgcatcttctttctcaagttggaagaggctgtactgaattaccaaatggcattatactctctgtgggggagcacagatgagtgtccggcagtccctgggatgatgttacagtccagaggtggggatgagatgagcccagatgatgcaatggggatgcaatcaagacacgatgtcattagaagccacagtgtgttctctcatgccacgtgtttcccagcttagaggagtaaggggtcaaggagggggggggtggccccctgggaccctgctctaggacgcatgcataaggacccacatgcaaacgcacagaattcaagagctagccaggcctggacccatgtaggagagccccactggctgatttccaatctgggacaaaggccacagacaggaggcctcccttggccacacccaggtccccagaacatatgctccactgtccccagtctaaccacaaccccatatgagctgtgtcccattcatgttggcctagaaactgggaagtacctggcatggggccctccgcttcctccccatgactgcctggagctctggggagaccaccaaggggccatttttgtggttaggaaatgtctgtggcagctgtggacaccacaggccctccctggacccttctgaagtagaggtcacattcctaaagattcttaactgccagctccaattgcttcttcctgaca

SEQ ID NO: 1139 - DNA, 700 bp, Homo sapiens
tgggaagtacctggcatggggccctccgcttcctccccatgactgcctggagctctggggagaccaccaaggggccatttttgtggttaggaaatgtctgtggcagctgtggacaccacaggccctccctggacccttctgaagtagaggtcacattcctaaagattcttaactgccagctccaattgcttcttcctgacaggctcatcttagtagggagtgaatataatcttttcccagttccacgaggtcctctcagatccaaaatgctctaagttcaaaggcaaatcatgaagaaagggagacgcagatactaatttgtggttttagttcagtggttttccaccttggctacacagtagagttacctaaggagctttttaaaaatactcatgtccaaatattccaacaggcactttgcaaagagaagatctaaatggctaacaaacatatgaaaggttgctcagctgtattagtcatcagggaaatgcaaattcaaaccacactgtgataccactacatacctgccagaatggctaacatgaaaaagatagaaaatatctatggttggcaaaaatgtgaagcaaccagaactctcatacattgctggagggagtgtaaatgggtacagccacctgggaacattatttggcataaggtactaaagctgaacatactcatatccatgcttccccagcaa

SEQ ID NO: 1140 - DNA, 700 bp, Homo sapiens
accacactgtgataccactacatacctgccagaatggctaacatgaaaaagatagaaaatatctatggttggcaaaaatgtgaagcaaccagaactctcatacattgctggagggagtgtaaatgggtacagccacctgggaacattatttggcataaggtactaaagctgaacatactcatatccatgcttccccagcaatggatatacatgtactccaaaaatacacactagcatgtcattgcaatagtcagaatagttccgaattataaataacaactcgaatatccaaaaatgcatcacagtagaatggataaatcgaggaatatccatagagtggaatactctatagcaagaagagtgaataaactgcagctctaagtaacaacttggatgaatcatctcacaaacacaacaagaggatatatactgcctgattccatttacatcatataaagtttgaaaacaggagaaatgactgtacaccattagaagccagaatggacattagcctttggagccaggtagtaagtggaaggggtaccaggggttgctggtgatgttctgtttcatgatttggatgctggttactcggggtaaattcattttgtgaaaattcactgagctttacacttatggtttgtgctttttttttttttttgcatatatgtcatccttcaacaaacacttaaaaaatgtt

SEQ ID NO: 1141 - DNA, 700 bp, Homo sapiens
aatggacattagcctttggagccaggtagtaagtggaaggggtaccaggggttgctggtgatgttctgtttcatgatttggatgctggttactcggggtaaattcattttgtgaaaattcactgagctttacacttatggtttgtgctttttttttttttttgcatatatgtcatccttcaacaaacacttaaaaaatgtttgaaaaccccatcaattcagtcagactctttgggtgggagcaagatccaggcatcagtattttttaatatcccagatgatggtaatatgcagccaggatttaaagtcactggtttaatatcttgggaaaagcagatccactcaagacctcacagggtcctgacaaaggccacttccagctcagtggagtgagacactggggtgggaagatgtccattttttggatgtgggtcagtctcttgcacaggcagaggtattgcagcatgctgttgtaatgtgtatcttccttggcagtgtctgttgaaagctggttgcatcagtttgtaatggggtgtaatggcaacaaggtgggcccagccccccccaggaagtggatcactgagcacagcttctacagggccatttgtagagaggtggcagctgggcttcccaggggctgccacccagggcagagccagtgctgaggctctgacaacctcggcagggtggggagaaggcca

SEQ ID NO: 1142 - DNA, 700 bp, Homo sapiens
gttgaaagctggttgcatcagtttgtaatggggtgtaatggcaacaaggtgggcccagccccccccaggaagtggatcactgagcacagcttctacagggccatttgtagagaggtggcagctgggcttcccaggggctgccacccagggcagagccagtgctgaggctctgacaacctcggcagggtggggagaaggccagactcagggtgtttatgtttgtgggtaatgacagtcagctctgggctccagatgatgcttactccctggcctctgtgttcagattaggaacttgcaacatcttgctgaggaccatgtcaggctcagctctaagtgctgtggctgagaattttccttcctctctgtgtggttagtggcagcctccctagcaatggctgacctctagcatactctgtcaaactacaggcagctgggacaagacaggacatggggctcacagacaggtattccacaacctgggccctgtcaaccctcccagaaatgcatgggccatgaacctcctgctgtgggaggggcagtgcagagaagtctcaataagcttctcttggccctctgggatctccaccatccacagtgtgtagggctgagctgcaggctgggtcttcaggtggtgtccctgcacatctgctttgcagcgtggcgtctatagagcaagagtgaacaggaaggggcctcgggc

SEQ ID NO: 1143 - DNA, 700 bp, Homo sapiens
aaatgcatgggccatgaacctcctgctgtgggaggggcagtgcagagaagtctcaataagcttctcttggccctctgggatctccaccatccacagtgtgtagggctgagctgcaggctgggtcttcaggtggtgtccctgcacatctgctttgcagcgtggcgtctatagagcaagagtgaacaggaaggggcctcgggcctcctgtagctctgctgggcagggacgctgcggggcctcagctgggcttccttggctaaagggcacagagtggcgtaggctgcaagaggacaagctaagctgatgaaggctctatcactcaagggtagccatgtaaaaaaaaatccctacaggtaaaagaagcatgaataagacaggcggggcataacagtgtctccccactgaagctgcaactctctgcttcactggcttcagcctcctctctgtgaaatgggggcaatgtcccctaggccttttcctcctgtccagtagggctgagggtctacaggccagagggaggcctgggctctgaggcctgtgcctgtgtggcctctggctgggacctcagcccccatgtgccatgtcacctcccttgtctgtgaaataccacaacagcagctcttgccagccagtgacactaccccttcctgttgtcttctttacaaagcatttatgaaatgcttccttttcatgcttcagg

SEQ ID NO: 1144 - DNA, 700 bp, Homo sapiens
ggtctacaggccagagggaggcctgggctctgaggcctgtgcctgtgtggcctctggctgggacctcagcccccatgtgccatgtcacctcccttgtctgtgaaataccacaacagcagctcttgccagccagtgacactaccccttcctgttgtcttctttacaaagcatttatgaaatgcttccttttcatgcttcaggaaaccggtggccaggaggagttcttgatttcattttcttccctagagatatgtgtgcttcgaaatacacaaattaaacaaaaacgagggctgactgggaccaggagagtgagtgatcctggcttcccttgatttacatgcttattttccttctcaaatcactccagtaagtacagaagtcactaatctattgccctctattatctgcattatagttaaaaacatcgacatgaacaaacaaaagcccttgcgtagcctagagaagtcacaaagctcacacccagactctcgcctaagagagtctctcagggctcactcagggactatttattcttgttttatttttttaaatgttgataccctctctgcttgagtatccttgttttagatgcaaatcagaaaaggttgctgtattgatcacagtcccagcaggaaacaaatgcacactccactggtaacaggagagactgaggaaaggaccgtttccaagggtgagcaag

SEQ ID NO: 1145 - DNA, 700 bp, Homo sapiens
agtctctcagggctcactcagggactatttattcttgttttatttttttaaatgttgataccctctctgcttgagtatccttgttttagatgcaaatcagaaaaggttgctgtattgatcacagtcccagcaggaaacaaatgcacactccactggtaacaggagagactgaggaaaggaccgtttccaagggtgagcaagatgaagagaaaccctcaaggaaaggtgaagcatcctgcagccagcaacagtgggagctgtgaccaccaatccccagggaggaggtgggagggctcctggaacccagagagacctgtaggaggggactgccggcaggagctgtggttttagggtgaaaaacacaggcactattgacctgagacctggcaagggagggagctggggggataaagcacctcccatttcccctcccagcctccaacctctggtcaggggaggggtcttcaattggccaaacccaactggaagcttggggacctggagcctggctgatggaatccacaaaggtcaaatcctgggaggagtgggaaagagcagaaaatcaactggagcagggatgtgtgggggggtggcaaacaaacaatgcccggcagagtcaccagggctggccatttgaaaagagtacatcagaagctaacgtgctgtaatgtggcactctcaccacaaatacataggatga

SEQ ID NO: 1146 - DNA, 700 bp, Homo sapiens
tggagcctggctgatggaatccacaaaggtcaaatcctgggaggagtgggaaagagcagaaaatcaactggagcagggatgtgtgggggggtggcaaacaaacaatgcccggcagagtcaccagggctggccatttgaaaagagtacatcagaagctaacgtgctgtaatgtggcactctcaccacaaatacataggatgaaaggcagccagggacagaggcggccacgaagaaaggtttaaagaatcccagcaaaatgactggggtcctcattatggaagaacaaatagctttacttaataattccaaggtaatagcttaatagcttaataattccaaggtaaacaagtattttcataaggaggactctgaatgatcaacagaaggttaaatgtcactgtactgcttcacagagctgttacagggcagggaagactataacacaatgtagagatagatccatacaagagaggtacaacagggtttccagttcaacacatcagttatttacactcctagtttcctttctctcctgaagcaccactaaaatgctagtctagaaatcaaatggggccaggtgcagtggctcacgcctataattccagcactttggtaggccaaggcaggaggatcattagagtccagaagttcaagaccagcctgggcaacatagcaagaccctgtcttaaaaaaaaaattg

SEQ ID NO: 1147 - DNA, 700 bp, Homo sapiens
tcagttatttacactcctagtttcctttctctcctgaagcaccactaaaatgctagtctagaaatcaaatggggccaggtgcagtggctcacgcctataattccagcactttggtaggccaaggcaggaggatcattagagtccagaagttcaagaccagcctgggcaacatagcaagaccctgtcttaaaaaaaaaattggctgggtgtggtggtgtgtacctggagtctcagctactcaggaggctgaggtgggaggatcacttgagcccaggagtttgaggctgcagtgagctatggtcacaccactgtactccagtctgggcgatgaagtgataccctgtctcttaaaaaaatcaaatggggccaggcgcggtggctcatgcctgtaatcccagcactttaggaggatgaggagggtggattacttgagatcagaagttcgagaccagcttggccaacatggtgaaaccccgactctactaaaaatacgaaaagtagtcaggcatggtggcacatgcctgtagtcccaggtactcgggaggctgagatatgagaattgcttgaacccgggaggcagaggttgcaatgagccaagattgtgccactgcactccagcttgggtgacaaggcgagactctgtctcaaacaaccaaccaaccaaccaaatggtattaactctcaaaggcaaagagaatgg

SEQ ID NO: 1148 - DNA, 700 bp, Homo sapiens
agtcaggcatggtggcacatgcctgtagtcccaggtactcgggaggctgagatatgagaattgcttgaacccgggaggcagaggttgcaatgagccaagattgtgccactgcactccagcttgggtgacaaggcgagactctgtctcaaacaaccaaccaaccaaccaaatggtattaactctcaaaggcaaagagaatggtaaaggagacatgagtggctgaaagagttccccaaactacaggaagctgggaggcaggtggaggaataatgactgacatggaggaagctaggctctgaagggcttgcagaggggcacactgacaggaggcaagccactttacccctggaaccctgcaggaggagctcagacttggggagtccaggtgttgtggctggtggggctgaggtacagcagccagtgggggtaatgaatggaggaaactggttgaaatcctccccaggtctcacctccacaccctgccccacacagctggagacaaagacactgaacaggagagagacaggcaggagggagggcagatgaatacagggatgaaaacagggaggtgagggaaaagtctgaagaatgaagcgtgggactcaatgtcccacccacttaccttgccccgccccaccccaggtatatatcactctggatgagggtatggtgaatttaaaagatggttgcaaattctttg

SEQ ID NO: 1149 - DNA, 700 bp, Homo sapiens
caaagacactgaacaggagagagacaggcaggagggagggcagatgaatacagggatgaaaacagggaggtgagggaaaagtctgaagaatgaagcgtgggactcaatgtcccacccacttaccttgccccgccccaccccaggtatatatcactctggatgagggtatggtgaatttaaaagatggttgcaaattctttgacatttctccaatggagaggtgggtctgtgtctccttccttgaacctatgtggatttctgactacagtggaaatgagctatgtgacttccaaggctgggacatacacagccatgcagcttctgtcttgctggccagaacactcacaccagagacttgaggtgcctcgtaagaggtccaatgaccaggccatggtgctggagacatcatgtgtagtctctctggtcaacagtcccaactgagcccagccttccagctctctttgccaagtgaacaaccatcttacaagtggacccttcagccccagctgttccaactcccagttattccagtcacctcgagtcattccagtcatcctagccgtcgtagagcagagaattgcccttctgactccttgacagtggcccaaaaaatggttgttgttttatgctactaagttttgaggtggtttgttatgtagcgttcaataactagaactaggagttagaatgcttctcttga

SEQ ID NO: 1150 - DNA, 700 bp, Homo sapiens
gccccagctgttccaactcccagttattccagtcacctcgagtcattccagtcatcctagccgtcgtagagcagagaattgcccttctgactccttgacagtggcccaaaaaatggttgttgttttatgctactaagttttgaggtggtttgttatgtagcgttcaataactagaactaggagttagaatgcttctcttgaggagctgaatggcttcagggtggtggttctcaacagggtgattttgtcccccaggggacatttggcaatgtttacagacattttggttatcacaactctgggaggggggttactactggcatttagtaggcagaagtcactggtgctgctaaacattctacaatgcatgagacagcctctgacaacaaggaattctttggcccaacatgtcactagtaccaaggttaagaaacctagctctagagaaaaggtgctcattggaggcttgttaactaaaagactgtcttgcttcctgtagtgaaaccccagttgataaattctccccaagcagagtttagttcagccttttattgctccattaataaataccaacagatagctgagatatttggcatttaaggaaagcctccaacaaggagagatggagagacagagagagggagaagaaaaagaaagcagaaggaaaaaggaagaaggattaaagaagagggaagaagaa

SEQ ID NO: 1151 - DNA, 700 bp, Homo sapiens
tgaaaccccagttgataaattctccccaagcagagtttagttcagccttttattgctccattaataaataccaacagatagctgagatatttggcatttaaggaaagcctccaacaaggagagatggagagacagagagagggagaagaaaaagaaagcagaaggaaaaaggaagaaggattaaagaagagggaagaagaagaacaagaggaagaggaggaggaagaagaagaagaagaagaaggatgacgacaacgacaacaacaacaacaacaagaagcagccaccaccgccgctgccacctccaggtagaaacaaaaacaaaatagagactagaagactattaagacaaatggacaaatgaaaaataaatagtgcctcaagaagaataggatggagatagtatatgcataaaaaagaatgtggtatttttgaaaaagaacaggaagaacaagaatgagtactaggatattagaaaaagaaagccaaaattaaaaaaaaaaatcaacagaagggttggagtatgaagtcaatgaaggtttcccaagaaagtagaccaaaaaggcaaagagatgaaaagtaggagagaaaatataaggaaactaaaacattaatccagatgatccaacagataaaatacagggaagaaaattattaaagaaataatacaagaaaatcttccaggactcaaagatgctac

SEQ ID NO: 1152 - DNA, 700 bp, Homo sapiens
aaaaatcaacagaagggttggagtatgaagtcaatgaaggtttcccaagaaagtagaccaaaaaggcaaagagatgaaaagtaggagagaaaatataaggaaactaaaacattaatccagatgatccaacagataaaatacagggaagaaaattattaaagaaataatacaagaaaatcttccaggactcaaagatgctacataactcagcagtgacgaatatgtccacattcactattgagttaaccacagattgtgttatgttcctattggaaggatggagagaggaaaagtggggatggttctgtaggaaagttcaatcctcatctatcacaagaagtcaacaaatgcctaaaatcggtagatcaaaaaatagtataaacagaaatggaaactagtaaatggttgaaagaggcagcctatagagagggggagtgagaaaggcggggaagggatttttattatgggcttctcagtacaactgatatttaaaccatatgcatgcattattttttattttgtttttaatggatacataataattgtagatatttatgcagtgcagtgtgatgtttccagacatacatatagcatgacatgatcaaatcagggtaattagcatatctatcaccttaaacacttgtcatttctttgtggtgacaacattcaaaatcatctcttccagctattttgaatttgt

SEQ ID NO: 1153 - DNA, 700 bp, Homo sapiens
gcatgcattattttttattttgtttttaatggatacataataattgtagatatttatgcagtgcagtgtgatgtttccagacatacatatagcatgacatgatcaaatcagggtaattagcatatctatcaccttaaacacttgtcatttctttgtggtgacaacattcaaaatcatctcttccagctattttgaatttgtgcattattttgataaatttgatagaatagaaattaatttaaaagggtacaattttaaaactgcaatgtgatgggatcaaatttaataatttggaaaattcgcttatgtagaagagtcatgcctctctaagaatgctcaatgaactggcataggtgggcacaagcaccatcagcatggaagggttcctcctgatgtcactggccactaaggcagttggtggggtgagggtggggatgagagccaggcatggcagcccttaggtggtcaccatttccctctcctggcagcctgtatttgcttgggagacctatctcttgggtatagatcctattgggctgctaaagaagagaggtgctaatccttttaggatgacttctgggaattcaccaggatgccctgcctctcctactctggacatggaaaaaaatgctgggtttaccaaaggtggatgagtcaggcccaggactagagccacggggcctctccctggacgtgccat

SEQ ID NO: 1154 - DNA, 700 bp, Homo sapiens
ttgggagacctatctcttgggtatagatcctattgggctgctaaagaagagaggtgctaatccttttaggatgacttctgggaattcaccaggatgccctgcctctcctactctggacatggaaaaaaatgctgggtttaccaaaggtggatgagtcaggcccaggactagagccacggggcctctccctggacgtgccatagtcaggctgtctcggcagctaaaagaggctacacacatttattgtcatcagaagctgggacagatgagccttgggttacaagatctcctacctggagctctcccgggaggtgccaatcataggggatgggaggacaaacacatgcttggtggggctccagcgttaccgccgaggtgcatctccttggccactagccctggggtctgacctccccttctcttttccttcacccattgttctccctattccctttctttcccacctctctctcagttctccagagctctgtgcagggactacttagcaaacttacctgctgaaatgcactgtttttttttttaaccttttaaattgtcacttttttttaaactataccatccttagataagcaggagatattccttgtagaaaaataagaaaatattaataatcacccatgattctatcagtcagaaaactccactgctggtgtatgaatttccagaatgtttccaggct

SEQ ID NO: 1155 - DNA, 700 bp, Homo sapiens
tacttagcaaacttacctgctgaaatgcactgtttttttttttaaccttttaaattgtcacttttttttaaactataccatccttagataagcaggagatattccttgtagaaaaataagaaaatattaataatcacccatgattctatcagtcagaaaactccactgctggtgtatgaatttccagaatgtttccaggcttataaacgggtaaaaatactatcacagtccatgtctcatctaagcacccagctactgagcaatcatcacctactgggctgtgctgaggcctttagatgtgttaatctctcttaatccttccaacttcacaagataggtgttattgtgccccgtttacaggcaggaaacaagttcagggagatcacattaattgcctgagttcccaagttggttaagagactaagctagatctcaacccttcaggctgaatccaaagctactttccttgaatggtttgtaagatttttccatttcttttttaaaaaaatggtatgttcaaatatctttctcatcaataaatatttatcttcatcattcttcctaatgacattcccttgtatgaatgtgccaatgtggaataaccagttccgtcttgttgggctttcagatgttttctttttgtaaatgataaacaatgcagttataactatctttatatataaactttgcaatagtatga

SEQ ID NO: 1156 - DNA, 700 bp, Homo sapiens
ttaaaaaaatggtatgttcaaatatctttctcatcaataaatatttatcttcatcattcttcctaatgacattcccttgtatgaatgtgccaatgtggaataaccagttccgtcttgttgggctttcagatgttttctttttgtaaatgataaacaatgcagttataactatctttatatataaactttgcaatagtatgagtattttcctagaataaatactggaaagtgaaattgcgtggtcaaaggccagacacatttttaaaagctgcctctttcccaatcacacatttcccacatccatttatttgctgaggatcttcacaaaatttggactgagattaaacacagaatcagagaagccctatgctggaaagatcttagtatatacctcttgaactaaaccagtcttactttagaaaaaaaaaaaaaaaaggccaggcgcggtggctcatgcctgtaatcccagcactttgggaggccgaggtgggcggatcatgaggtcaagagattgagaccatcctggccaacatggtgaaaccccatctctattacaaatacaaaaattggctgggcgtggtggcgtgtgcctgtagtcccagctacttgggaggctgaggcggaagaatcgcttgaacccgggaggcagaggttgcactgagccgagattgtgccactgcgcttcagtctggcgacagag

SEQ ID NO: 1157 - DNA, 700 bp, Homo sapiens
gaggtcaagagattgagaccatcctggccaacatggtgaaaccccatctctattacaaatacaaaaattggctgggcgtggtggcgtgtgcctgtagtcccagctacttgggaggctgaggcggaagaatcgcttgaacccgggaggcagaggttgcactgagccgagattgtgccactgcgcttcagtctggcgacagagcgagactccatctcagaaaaaaaaaaaagccctagaccctctgcagcagcctgctgtgccttcagtgggccaggcagcacttctgggcaagtgaggaaagggagacccggagggaggtagggaagtgagggcaagagggccatgctgtgggcccacaaccaactggcttgggggaggctgctacattttcccaagtgcaacactgtcttcctgagtctaaagacctcacagccatcactgactatactgagctgcctcactgtccccaggactctcactctatccaggaagtcaacgcaaagtctcttgggccttccctttatccagctgccaacacttagcaccctggtcttccttggacagtttccaaggctacgttgggcagtcccaaacaagatgtggtcttattgttgtcttaccttggtgtgttttcctccaataggctacaaactctggcacctgcaaaaaacaaggaaagtaaatgattgaagcagggcac

SEQ ID NO: 1158 - DNA, 700 bp, Homo sapiens
aaagtctcttgggccttccctttatccagctgccaacacttagcaccctggtcttccttggacagtttccaaggctacgttgggcagtcccaaacaagatgtggtcttattgttgtcttaccttggtgtgttttcctccaataggctacaaactctggcacctgcaaaaaacaaggaaagtaaatgattgaagcagggcactgaaggtgggcctttgaacaacgcaagcctggatggaagttgaaagatgagagcccatctgtggtgagttctttgaaagctgctgaggtgtgagttggtaggatgctggcccagggcagacacgggcacaagcttccacccagcggcattctccactcagagggtttctttctcatttggcctgttaatgctcctatactggcagaaacctcagtgcccttcccactttgtctcaaggccttgtataaaaaataagttgtcccttcattcatttccatggatatatccattcatcagctatttactgagcacctactatatgccaggcactgtcctagggctctgggaatagagcattggactaaaaaggctaacaccctgccctcatggagcttgaagtctactgggtaggggggtggggcggtggtggtagtgaagagtccaaaaactaacaagatacataaattaaaaatataggaatcagaagtggtaaatccta

SEQ ID NO: 1159 - DNA, 700 bp, Homo sapiens
tatttactgagcacctactatatgccaggcactgtcctagggctctgggaatagagcattggactaaaaaggctaacaccctgccctcatggagcttgaagtctactgggtaggggggtggggcggtggtggtagtgaagagtccaaaaactaacaagatacataaattaaaaatataggaatcagaagtggtaaatcctagggaggaaaaaataaggcaggagagagaggtaaggaatattggggcagaaggtgagaaggcgtgtaaaaattctaaaatgtgtgtccagagaaggctagacacctgagaaggtaaattatgaacaaagttacctgaaaaaagtgaggacatgagccctgagaattaacggggaagaagcttcccaggtggagggaatggcaagtgcaacagcctggcagcgagggcctgtctgacatgttaacagataagtgaggagggtggtgtagccagagtagagagaataagggagaagcaggagagggatcagagaggtagcgagaggctccacagtgttcacggcattcaagggaggtccttgtgtgaacttgggctctgattctgagacaggagccactagagggttttttacagagaagtgacatgatgtaactcacattttaacaggatcactctggatgctgtgttgagaataaactgagagaaagagtagaaccagtt

SEQ ID NO: 1160 - DNA, 700 bp, Homo sapiens
gagggatcagagaggtagcgagaggctccacagtgttcacggcattcaagggaggtccttgtgtgaacttgggctctgattctgagacaggagccactagagggttttttacagagaagtgacatgatgtaactcacattttaacaggatcactctggatgctgtgttgagaataaactgagagaaagagtagaaccagttaggaggctatggcagaaatcttggcaagagacaatggtggcttggaccagagcagtagcatggaggatttgctgatggattggaagtgagagattaaaaagaatgggtttagaacctgactggggcaggttaaaaagaaaggagctgaagctgtgaactaggagacagagttggctgggagcagcaggaagattcccagttttggcctgagcaactgggaggatggaattgccattttctgaatggaagcgtacagatggagcatgttttgtggggagataaggaatacggttttggacgtaagtgtgagatgccttttaagcacttaagtggagaagactgtaggcaggtggaactgtgaatctggggagaggtccaggctggaaatgagtatttgtgagttctcagcacatagttctttaaagctgtgacacaggatgagatcatcaagagggtggatgtcaatagggaagctgtcggccgggtgcggtggctcacg

SEQ ID NO: 1161 - DNA, 700 bp, Homo sapiens
cgtaagtgtgagatgccttttaagcacttaagtggagaagactgtaggcaggtggaactgtgaatctggggagaggtccaggctggaaatgagtatttgtgagttctcagcacatagttctttaaagctgtgacacaggatgagatcatcaagagggtggatgtcaatagggaagctgtcggccgggtgcggtggctcacgcctgtaatcccagcactttgggaggccaaggcgggtggatcacctgaggtcaggagttcgagaccagcctggccaacctggtgaaaccccgtctctactaaaaatacaaaaattagctgggtgtggtggcaggtgcctgtaaccccagatactcaggaggatgaagcaggagaatcacttgaacccaggaagcagaggttgcagtgagcggagattgtgccattgtactccagcctgggtgacagagcaagactctgtctcaaaaaaaaaaaaaaaaaaagaaaagaaaagaaaagaaaagaaaaaaaaaaaccagggaagctgtgcaaggggctgagccccattcagtagctcagcaaaagagactgaaaaggactagcaagtacagtaggagggaaacctggagaaagacttctgaggaggatggcatagtccactgtgatagatcaactatttaataatatgaagacagagatttagcatcttggagtcacaggtg

SEQ ID NO: 1162 - DNA, 700 bp, Homo sapiens
aagaaaaaaaaaaaccagggaagctgtgcaaggggctgagccccattcagtagctcagcaaaagagactgaaaaggactagcaagtacagtaggagggaaacctggagaaagacttctgaggaggatggcatagtccactgtgatagatcaactatttaataatatgaagacagagatttagcatcttggagtcacaggtgatcctggtcagggatgattcagtggaacagttggagtgagaatctgactacagcaggttctaaagagaggagctgaatttgggagctgagggatggagttggctggtgacagcaggagggctggaagcagagggagagggatctaacctacattggttccaccttaagagaaaacacaaagctggtacttcctcaacacctgtacgtggccgctgttgttactaacactgggccaggtcctccagcttgctgagcaccacccaggtctggtcctataagctagctctccacctgtttctagattcctatgaagttatttcctttttctcactgctgtgtgtagccttaggataaatgcccatagcttggggctgctgagcaagtcctcagttgcttgttgaccaagatctggcttgggtcctttctcctaatgggaagtcagagtgagcaagggactctgctcttggatagcttgccttctgtgcaggagataaataat

SEQ ID NO: 1163 - DNA, 700 bp, Homo sapiens
tagattcctatgaagttatttcctttttctcactgctgtgtgtagccttaggataaatgcccatagcttggggctgctgagcaagtcctcagttgcttgttgaccaagatctggcttgggtcctttctcctaatgggaagtcagagtgagcaagggactctgctcttggatagcttgccttctgtgcaggagataaataatcaccaaggaaatggatatgcaggcaggtaacttcagatgcagatgggtgctatgaagacagtaagctggggtgaaacacacagagtaagtgtgggagcgacctcctttcgccaggctgtgtggtcaggtgcctctctgggaggtgacatttaggatgacacctagacagcgatgcccagcttattctcctcaagctggcctctcctctgctgctcccagccttccccgtggcttctacaatatctgcactctgggaacaaggccaaggccttgggccatctaagtgcaaagccaaaaggaaacaatcctcttctctcgccaatacacaccatgggaactttttctccatgattacaaaatacgtgcattttcactgaaggaaacttggaaatattgaaaacaggagaaaacgtgtcattctactacccagaaataactacaattaactttggatgcatccttctagacattcttctatgcatatatataggtatttttt

SEQ ID NO: 1164 - DNA, 700 bp, Homo sapiens
gaaacaatcctcttctctcgccaatacacaccatgggaactttttctccatgattacaaaatacgtgcattttcactgaaggaaacttggaaatattgaaaacaggagaaaacgtgtcattctactacccagaaataactacaattaactttggatgcatccttctagacattcttctatgcatatatataggtattttttttcttatttccttgggttaaaaatgagatcatgtacattgtgttttatgatctgaattttgactaaatctgttataaagcactcttctcatgaaattaattttcttctacataatgagtttaaatggctgcattaaaagtatttcattatatgtagatttttaccatattttatttaattcctaaacattggccatttacattgtttcctatgattgttactaccagcaaatgctctaataaacaatcctgtatatttttccttggagaagggggtttgccaatctcttatttccttgggttaaaacaaaatgtcactgcccagtggcagtgccatgggtctcatggcagcctgaggctgagggcatgggagggcaggaatgagccccaagcctaaggagccactcagatgccagaggctgatttagtcctatgacatgccaggtcttgagttttcctcccctgagggcctgatcagtacgaaaacaataggcctctcc

SEQ ID NO: 1165 - DNA, 700 bp, Homo sapiens
ggttaaaacaaaatgtcactgcccagtggcagtgccatgggtctcatggcagcctgaggctgagggcatgggagggcaggaatgagccccaagcctaaggagccactcagatgccagaggctgatttagtcctatgacatgccaggtcttgagttttcctcccctgagggcctgatcagtacgaaaacaataggcctctcccataaacccagagaaatccaaggggattccccacctcagcaggaagagggtgtcactctctgaccccagaatagagaccacctccatcctcccttgaaatcccctggggaagcttctcctgccctccctccctggggaaaacattggcacggtcaggccttcaatctctctttggggaggggctgccagggaatgctcaggaaacagaaggttccataggaatagcagggcctgtcctatccctgacccagccttttccctaaatcctcaaattccccacaggggctggcagggacagtctatgctccccgtaagaggatgtcctgagggctagtgagttctagggtaaggtgggaggccaccagatgagggtttgaatccaggctctgacattccagcctcgtcttgggcaagtgacttcacctgtggaatgtgagctacgaggaaggaacttagatttgcggcccttagcattcaacaggggctctataaataccag

SEQ ID NO: 1166 - DNA, 700 bp, Homo sapiens
tctatgctccccgtaagaggatgtcctgagggctagtgagttctagggtaaggtgggaggccaccagatgagggtttgaatccaggctctgacattccagcctcgtcttgggcaagtgacttcacctgtggaatgtgagctacgaggaaggaacttagatttgcggcccttagcattcaacaggggctctataaataccaggccaggccaatgcatgatcctgtctgagcctcagctgctcatatgtgaaatggatgacacctatctcacaggtttgttgtagggactaaatacaacttaatacagttaacactctactgtttgagaaacattagagtccaaagccctggagggctacttccaccacgccccatgctttgtagtctcctctttttggcagaactagtttacctccacactgctactaccacaccctagacatacctctggtgtagtatgcagcacattgtgtgtgtacttgtccaactcctccatgaagcttcagggcagttaaagacaagaattttgcctctctatcgtctgtgcctctgaatgacactatgaagtaagcaagggcattatttccattctacaaatgagaaaactgaggcttagaaagattagatgccttgcccaagtcacacagtggagagtaggagagcaagacctaaacctggttctcatttctgggcctgtgttc

SEQ ID NO: 1167 - DNA, 700 bp, Homo sapiens
cttcagggcagttaaagacaagaattttgcctctctatcgtctgtgcctctgaatgacactatgaagtaagcaagggcattatttccattctacaaatgagaaaactgaggcttagaaagattagatgccttgcccaagtcacacagtggagagtaggagagcaagacctaaacctggttctcatttctgggcctgtgttctgtaaaccaaaaagaaaattccaaggcaccccccagctgtctgaatagacccctcctctcggccaagggcattccaaagttaacctgaaaaactagtttaggccatgatgggaagggggagccagacatgcctcgttataccctcttcccttttggaattactgactctttaagactgataagagatatttacagtccattctctctgaagcctgctacctggaggcctcatctgcataataaaaccttggtccccatagccccttatcgtaacccagacattcctttctgttgctttctattgataataactctttcaaccaattgtcaatcagaaaaatttttgaatccatctatgacttgaaaccacccccactccccaacctagttgtcctgcctttttggacagaaccaatgtacatcttatatgcattgattgatggctatgtctccctaaaatgtataaaaccaaattgtggcctgaccactttgggtacat

SEQ ID NO: 1168 - DNA, 700 bp, Homo sapiens
ctattgataataactctttcaaccaattgtcaatcagaaaaatttttgaatccatctatgacttgaaaccacccccactccccaacctagttgtcctgcctttttggacagaaccaatgtacatcttatatgcattgattgatggctatgtctccctaaaatgtataaaaccaaattgtggcctgaccactttgggtacatgttctcaggatctcctgagggctgtctcacaggccattggttacttatatttggctcagaatagatgtcttcaaatattttacagtttgaccgacaactctattctagatgattctcttgcaaaagggagttggaggtgagaaggaagtgagccaattctcatgtccctgagaaaaaggcaggcagagcttcgagaggaaggaggtgcttggggaggcagcaggacactgcacttgcctcagccccatcctgactccccgtggatcatcgtgcatgcagcagctgtgacccccagaggcctctagttcagcataagctgaggcaaagggggcccccaggttccctctactggtgtggagcccagccggcaaggggactggggatcggcggcccagagttgattgttgtggccccagcagcaggatgatggctgtagagcacctgctcaggagttggcctatctccagctatggggcgggaaggctccctaccagaccac

SEQ ID NO: 1169 - DNA, 700 bp, Homo sapiens
cctctagttcagcataagctgaggcaaagggggcccccaggttccctctactggtgtggagcccagccggcaaggggactggggatcggcggcccagagttgattgttgtggccccagcagcaggatgatggctgtagagcacctgctcaggagttggcctatctccagctatggggcgggaaggctccctaccagaccacacacatcttgatgtactcaccctgtgagcccaggacccctgtgatacctgctgaggtgaaggctgaatgagtgagagctcccagcctccagcatcagggcattagggagaagaagcagctagactcaagccagggatgcagagggagggaacaggcatcaggtagtaggtgttttaatgtcacctacctcttattatgttgtatgtttctggaggatgggtccatggctgatccatccttgtgtctctactacaaccagcagattactttacagagagttgatactcagtaagtacagcttattgaaggtgtaaccaaaagccagtaggcaggatgacagatggcatccgccttgcatgtctgggtcatcagggaaagggccaatgtccagtgtgtcctgaccaggatggttctgacaaggacatccatagcatccacagagggtgctccctccccaggcaacaaactctccctccctcctttctttcttccttccctt

SEQ ID NO: 1170 - DNA, 700 bp, Homo sapiens
cttattgaaggtgtaaccaaaagccagtaggcaggatgacagatggcatccgccttgcatgtctgggtcatcagggaaagggccaatgtccagtgtgtcctgaccaggatggttctgacaaggacatccatagcatccacagagggtgctccctccccaggcaacaaactctccctccctcctttctttcttccttcccttttttttgagatggagtctcacttattgcccaggctggagtgcagtggcacaatctcggctcattgcaaccttcgcctcctgggttcaattgattctctggcctcagcctcccgagtaactgggattacaggcatgtaccaccatacctggctaatttttgtatttttagtagagataggcttttgccacgttggccaggctggtctcaaactcgtgacctcagttgatctgcctgcctgggcctcccaaagtgctgggattacaggcatgagccaccgctcccagcacactctccctttcttagccaaagagacaccacttggaggaaactacctggatctaggtgcttccctagtgacaaaaatggactggggatgtggtataaatccttgcccctgggaatctggaagggacctatgatatgagaaaaaacaaacaaacaaacaaacagaccaattatctctttattgagaccaaaactgctgcttttgcctgaatg

SEQ ID NO: 1171 - DNA, 700 bp, Homo sapiens
tcttagccaaagagacaccacttggaggaaactacctggatctaggtgcttccctagtgacaaaaatggactggggatgtggtataaatccttgcccctgggaatctggaagggacctatgatatgagaaaaaacaaacaaacaaacaaacagaccaattatctctttattgagaccaaaactgctgcttttgcctgaatggtcagattgactgattcctcttccacttgccatccccactgcatgcatggctacaaataatcctgatgttgcacatttaaaatagtgccttgcttcaactgcttcagtctatcagtgtaaactgtgtctcccctggcaggtatgctgtgggggacagtgcagggcttgtctctgtaggaccaaactcagtatgaacttatcacctgcctgtgtgtacagctttaagcttcaggtagagggtgttataaaccctggagtaggacttccctagagaacaggtcattacactatgtccatctattgaggccctaaattaagtctacagaattaggcctaaactccgcagacagtagccaaaggtctcaggctctggcccactccacctgtccatccacacctccttctcatcttgcccttcactcacttaacacagtgcccaaagggagatgcagttgcctggacaggctggctttggcttaagctaggggttcttaaagaa

SEQ ID NO: 1172 - DNA, 700 bp, Homo sapiens
tattgaggccctaaattaagtctacagaattaggcctaaactccgcagacagtagccaaaggtctcaggctctggcccactccacctgtccatccacacctccttctcatcttgcccttcactcacttaacacagtgcccaaagggagatgcagttgcctggacaggctggctttggcttaagctaggggttcttaaagaatagtccccagaccagcagcatcagcatcacctgggacttgttagacctcctgaattggaacctgtgggatgagactcagcaaactgttttaatgagtcttctaggtgattttggttgcactaaagtttgagaaccactgggtgagccattccctgagcccaggttgcctttctcagccattttctgcctattataatctcaaccacctttcaaagttcagctcaataccatctcttttgggaagcccccgtagtcccccaagtacttgtgaaggcctcttccttgaaccgacagcttctttgtcaccccatcccccattctagtgaaagaccttcatttctgcttctctttgcagcatgtattttctgctttgttttatagtaaactttgagcagttgttaactgccttcccacactgattcccctctaacacacaaatgttactctgtaaaggccatgtcttacttcactcattcttttttattttttatttttgaaa

SEQ ID NO: 1173 - DNA, 700 bp, Homo sapiens
tttgtcaccccatcccccattctagtgaaagaccttcatttctgcttctctttgcagcatgtattttctgctttgttttatagtaaactttgagcagttgttaactgccttcccacactgattcccctctaacacacaaatgttactctgtaaaggccatgtcttacttcactcattcttttttattttttatttttgaaacaaggtctggctctgttgtccaggctggagtgcagtggcatgatgttggctcactgcaacctctgactcctgggctcatgtcatcctcccacctcagcctcccaagtagctgggattacaggcctgtgctactgcgcccggctaatttttgtatttttagtagagacagggtttccccatgttggccaggctggtctcggtctagactcaagtgatccgcccaccttaacctcccaaagtactgggattacaggagtgagccactgcgcctggtgcaatttgctcattctttgaataaatgtccactgaggatctgctctacatggcgggggctgtgctaggcactggggttcagacaaaggtgcacccttatacttatcatccaggagccagtggggtgaatggcaaggtggctggcaattgcaatactttgagtagcactgagacagaatgcttccaaccacagggggccccctcatgcccctccctgttgggaccc

SEQ ID NO: 1174 - DNA, 700 bp, Homo sapiens
atgtccactgaggatctgctctacatggcgggggctgtgctaggcactggggttcagacaaaggtgcacccttatacttatcatccaggagccagtggggtgaatggcaaggtggctggcaattgcaatactttgagtagcactgagacagaatgcttccaaccacagggggccccctcatgcccctccctgttgggacccacccaaaaagtaacctctgttctaacttccatcaccagagattaattttatctgtttttgccttttgtttgagacagggtcttgttctgtcgtccaggatggagtgcagtggtgcgatcatagcccagtgcagcctcaaacgcctagactcaagcagtcctcccacctcagcctcttgtgtagctaggactacaggcatgtgccaccatgcccagctattttttttttttttaaagagacagagtcttgctatgttgcccaggctggtctcaaactcctggtctcaagcattcctcctgtcttgacctcccagagtgctgggattacaggtataagccaccgcacccggccaattttatttgtttttaaacttcatataaatagaatcatacaatgtacctttcgggtgtctggcttcttcccactacacattatctgtgcgatccatgtatgctgttatgtatagacacagtttgttcttttttaagattgctgtgtt

SEQ ID NO: 1175 - DNA, 700 bp, Homo sapiens
gtcttgacctcccagagtgctgggattacaggtataagccaccgcacccggccaattttatttgtttttaaacttcatataaatagaatcatacaatgtacctttcgggtgtctggcttcttcccactacacattatctgtgcgatccatgtatgctgttatgtatagacacagtttgttcttttttaagattgctgtgttgtatcccattgtgtagatatgacacaatttaaccattctactgttgatggccatttgtgttgtttctagtttggggctcttatggagaaagatactattagacataagacaaaaacattttggtttatgtccgctggtggacattctggacattcgcactcattcctcttgagtatgtacctagaggtggaactgatggtttatggaatgggtatagtcttagctttagtagatactatcaaatagttttccaaagtgattgtaccaatgtacactcctaccagcatataaaagtgtttgccaacatttggtatcatcagtcttcaattttagtccttcctgtgggtatagagttgtatcttttacgttttaatttgcttattggctatttatatatccacttttaagatgttcctgtttaagacttttgcctatttgcttttttcttatttacttacaggaattctttggaccttctggatataagccccagtcgtct

SEQ ID NO: 1176 - DNA, 700 bp, Homo sapiens
tgccaacatttggtatcatcagtcttcaattttagtccttcctgtgggtatagagttgtatcttttacgttttaatttgcttattggctatttatatatccacttttaagatgttcctgtttaagacttttgcctatttgcttttttcttatttacttacaggaattctttggaccttctggatataagccccagtcgtctgtcggatatgttacagagaatatcctctcctcttccagtctctggctcgcctttccactaggttttttgtttttttttttctgagacagagtctcgctctctcacccaggctggagtgcatggcatgatctcggctcactacaacctccacctcccgagttcaagtgattctcctgcctcagcgtcccgggtagctgagactacaggtgcccaccaccatgcccggctaatctttgtattttcagtagagacgggatttcaccatattggccaggctggtctcgaactcctgacttgtgatccgcccatctcagcctcccaaagtgccgggattacaggtgtgagccaccgcacccagacgcctttccactctttaatggtatttttgatgaacaaaagttcataaatgttcaatttacccatcttttcatctatggctagtgtatcctgcttaagtaatcttagttccaagaagtccagttaacagaaataacaaaaa

SEQ ID NO: 1177 - DNA, 700 bp, Homo sapiens
gatccgcccatctcagcctcccaaagtgccgggattacaggtgtgagccaccgcacccagacgcctttccactctttaatggtatttttgatgaacaaaagttcataaatgttcaatttacccatcttttcatctatggctagtgtatcctgcttaagtaatcttagttccaagaagtccagttaacagaaataacaaaaattactaatattaaaaaagacaaagaagtgaaggaaaaaattggatggtgggtgtgggagaaggactgcatcagatcgtgagagtgtgctcacttgactgtgctgtgcaaagcccgggccttgtcctgtgttgtggtatggatgggagctgaacccccaggcagtgcaacaaacatgccctctgtttggttcagatgctgcgccaggtggtggaaagggctctgtgggctgtagggggaccctggctcaatggcttaagagaaagatcactccttttcatgtgtgttaagctgggtctgacccccaaaccctggagactccctttagtccaggccctgcgcctctgtgccagagcctgcaaagacagcagtgctgacacttgtccagctggctcacaaaggggaaattctcccctccttgagtcaccacatagacaggaggagcttcaaataacaagcgctcgactccaaacgatccctatgctcatttcacgatgctgc

SEQ ID NO: 1178 - DNA, 700 bp, Homo sapiens
acccccaaaccctggagactccctttagtccaggccctgcgcctctgtgccagagcctgcaaagacagcagtgctgacacttgtccagctggctcacaaaggggaaattctcccctccttgagtcaccacatagacaggaggagcttcaaataacaagcgctcgactccaaacgatccctatgctcatttcacgatgctgcatcactttcaaaatcccctgtgatgcttgtgtatgaagtctagatccagaaactttccccatgttttccccagtttgagtagaacaataccctgggagtcacaagctacatcatacaattgacttccctaaaaaaaaaaaaaaaaaaagagatcttggactcaaggttatgagtttgcagtgtcctttgcagggtcttttaaatcccctagtggcatatgaaactctggatgtttgtgaattttcctggggaaagggtctatgtgtgccatcagattccggaaggggtgtatgacctcaaaaaaaggtaagactcactggaccgagtcccctttaaggatagtttgcagtcctcttctgctgggaggtgatggtagtaggcttgccaagaggacctcaacctaccagatggatgcgatctgccatccacctccccagcataaagccagttcataaagccagctccagcatctctggggcagttttcttcccatccaggg

SEQ ID NO: 1179 - DNA, 700 bp, Homo sapiens
aaaaaaaggtaagactcactggaccgagtcccctttaaggatagtttgcagtcctcttctgctgggaggtgatggtagtaggcttgccaagaggacctcaacctaccagatggatgcgatctgccatccacctccccagcataaagccagttcataaagccagctccagcatctctggggcagttttcttcccatccagggtcaagctcttggcggcttagagatgcagtgtgccagtcccaacaccatggctgtgtgtcactgcagatgaaggcatactttttttctaggacgtgcagtgaccccacttggcagcagacactcatttctgatatttttgtatgccaagtcttgggtaaaacaactaagtgatctcttaaggacccaggttccttttttgtccctgttccttgcccctcaccaccactttttccatgtgccaccctctcataagaactcagaagcccagggtggagtcaaaggggtcttttaaatcccctagtggcatatgaaattctggatgtttgtgaattttcctggggaaagggtctatgtgtgccattagattctggaaggggtgtgtgacctcaaaaaaaggttaagacccactggaccgagtcctctttaaatggaagtgcatggatcagtttgataaaattaatttatagtaatgagctatgtatctttagctaactgcact

SEQ ID NO: 1180 - DNA, 700 bp, Homo sapiens
tagtggcatatgaaattctggatgtttgtgaattttcctggggaaagggtctatgtgtgccattagattctggaaggggtgtgtgacctcaaaaaaaggttaagacccactggaccgagtcctctttaaatggaagtgcatggatcagtttgataaaattaatttatagtaatgagctatgtatctttagctaactgcacttctaaaaagacatctgggaagggagaacgcttaactaaaattattattataattattattttttgagatggagtattgctcttgtcgcccccaggctggagtgcaatggcacgatctcagctcactgcaacctctgcctcccaggttcatgcaattcttgtgcctcagcctcctgagtagctggaattagaggtgcccaccaccatgcccagctaatttttgtatttttagtggagacagggtttcaccatgttgcccaggctggtctttaactcctgacctcaagtaatctgcccacctcagcctcccaaagtgttgggattataggcatgagccactgcacctgacctaaaattatatttctaatgacaaaactgaggtacagctcataactaaataggggagaatgacattaaagccactcccatcactaaaaaagaccaatttttctggtctagatggctttttagaggctcctggagcaggaacaaggggttag

SEQ ID NO: 1181 - DNA, 700 bp, Homo sapiens
ctcagcctcccaaagtgttgggattataggcatgagccactgcacctgacctaaaattatatttctaatgacaaaactgaggtacagctcataactaaataggggagaatgacattaaagccactcccatcactaaaaaagaccaatttttctggtctagatggctttttagaggctcctggagcaggaacaaggggttagtgactacgatgtgtcaaaagagacataggcatttctcagataaacctcagctcttccggcttgagagaaggaaacattcccaacatgacttaggggcccaaggaccctgtttccacctcatatcagattgtcaaatgggaagggtgtgcctagggcacacactccctcccgaaagggctgagtccccagaagacctatgtctgctccatcctgggtccctgctctctcctggagacaagatacagctgcctgtatgagtagcagtctggggcctcctcctccctccctctgccccaccccactcctccctgcccgcccccatacacactgggttcttcctcccctgctctctctcaagaagccaggcccctgcccccactcacagtcagaaggaagtgattctgcaaggcctcccagggactcccaggactggctcaaggcatcagactgttaaataagtgggattttttcagtgtttgtagaaactgttgtttaaaaa

SEQ ID NO: 1182 - DNA, 700 bp, Homo sapiens
ccactcctccctgcccgcccccatacacactgggttcttcctcccctgctctctctcaagaagccaggcccctgcccccactcacagtcagaaggaagtgattctgcaaggcctcccagggactcccaggactggctcaaggcatcagactgttaaataagtgggattttttcagtgtttgtagaaactgttgtttaaaaagatgtaaccatccaaactgtttatgtaacccttgggaagtctcaacagatatggttccctatttataactgtggccaggactttaaaaatacaagtggagggggactgtcaaaatcagagaggttgtcacgttacagttgtatgcttgcataactgaattcagtattttgctctaatttgagaagtttctttttattcacttttctccttttctggttttctcttcctttgttgtccactgctgtgcaccatacactcctgacattttctgagaacatcagaactatttctctgaagtggaggttcaaaataggggtttttagaatgaccaaataataatgaacactaaaattcatttcaaagcctaggactagtctattcatactgatattcctagtctacaagggtaaacatagctgtcttctcgccgccagcccctacacctgcaggggcctgctctgtctctgggttgtccgctctggaggtaggtgtcagacca

SEQ ID NO: 1183 - DNA, 700 bp, Homo sapiens
ggaggttcaaaataggggtttttagaatgaccaaataataatgaacactaaaattcatttcaaagcctaggactagtctattcatactgatattcctagtctacaagggtaaacatagctgtcttctcgccgccagcccctacacctgcaggggcctgctctgtctctgggttgtccgctctggaggtaggtgtcagaccacctggtctcactttcctaggtccaatctctggatctatggcaacagaatccacaggtccctattcccatacagggggaatgcaaagttgctgggggacaatcacagtgcaaagctgagatctgggcttctttctagagccattctgaggtcttcatcactcacactaacaatccaactaaaacctggctcttgtaggaacacatcctcttctttattagggaggctgttctctgagttaacatagtagcagtttcgttcacagatctttctggcaaaaaagaatccgacgagagctatgcctccaccaaaggcacagtttgataacactttggggaaggatggttcatagctcctgaagaagaaagagtctgtgataagaacctctggcccacaggcttcttcacactacacaacttccaaaatccctaaccactgctaatagctaggaggaggatagtgactgttcccaacacaaagagatgacaaacatttgagatg

SEQ ID NO: 1184 - DNA, 700 bp, Homo sapiens
gcctccaccaaaggcacagtttgataacactttggggaaggatggttcatagctcctgaagaagaaagagtctgtgataagaacctctggcccacaggcttcttcacactacacaacttccaaaatccctaaccactgctaatagctaggaggaggatagtgactgttcccaacacaaagagatgacaaacatttgagatggtggatatgctaattaccctgatgtgatcactatacataatatgtattgaaacatcattatgtaccttgtaaatatgtataatcattataacacacaatatgaggtcccagacaatgataatacataataattatacgtttatgggatacatagtgatgtttcaatatgtataaattgaagtggtgtgaattatgtataaattttaactacattaaaaattacagaaaaataaattttaaaaaacaaaacaaaaaaaattcttaactgctgtcaagctagcactgacaaccgaagcctcagcccagtacctccctgcttccacctgtgctgaccaccctaagagagaaggcagaggcacacagcccttacatcttggtggggaaaccctagggtttcctctgagggcctgacagattgaaggggttgaaaatgagtggagggtgtggccacctcagctctagcctccttctgctgagggacagtggccaaggaacatcc

SEQ ID NO: 1185 - DNA, 700 bp, Homo sapiens
cagcccagtacctccctgcttccacctgtgctgaccaccctaagagagaaggcagaggcacacagcccttacatcttggtggggaaaccctagggtttcctctgagggcctgacagattgaaggggttgaaaatgagtggagggtgtggccacctcagctctagcctccttctgctgagggacagtggccaaggaacatcctcatagatccaaaggaaggtggagagtccctctttgtcctctccacccacctcatccccaccacgccctgatgtcactccctgctgtacccaccccggaaacccttagccacttcccacaggtccactcccagggaagttctttaattggtggatgtgggaaagaggaagaggaaaaatatcatttctaccttcccaattccctgtatcccatgagcctccagtctgaaaatgattacccatctgacctggagctctcatcctaggtatcataatggctcttcttttacccataaggagaatgggtaatgaagaaatgcaaaatcccaactcatgaaaatgtggttgaaaaagggaagacccataaaagttctcatttgttgaccagagacaataaagtgattacttaaaaaaaaaaaaacccacctctggggtctttccaaatcatggagaaaaataaaaacaggggaagacatgctctagtcttaaaactccaatgt

SEQ ID NO: 1186 - DNA, 700 bp, Homo sapiens
gaatgggtaatgaagaaatgcaaaatcccaactcatgaaaatgtggttgaaaaagggaagacccataaaagttctcatttgttgaccagagacaataaagtgattacttaaaaaaaaaaaaacccacctctggggtctttccaaatcatggagaaaaataaaaacaggggaagacatgctctagtcttaaaactccaatgtggccccagactggtgagccccaacaacagtaaatacccaccctcagcagccttctgcccacctcaccccaccaatactaggtcccagacaagtcaacaaacacttattgaccatgtactgtgtgcttccaaccattccgggagttggaattctgcaacctcaaggtgctttgcgaggagcagggaaacagctcagtcaacatttactgtgtgctgacgttttgctaggtttagaggaggcaaaaatctgagaaaaaaacagctaagaatactccaatctgggaagtactaatatacacatagcaccataggagcaaggaacaattaattctacatggtgaggtcaaccagagaagatgatttttaagttgggccttgaaagcacattaggattttgctgggtataactgggaaggagtggcattccaggcagaaagaactgagtgagcaaaggtcagggttggggttggtatgggcagttggttgtatgtgatacggcg

SEQ ID NO: 1187 - DNA, 700 bp, Homo sapiens
atagcaccataggagcaaggaacaattaattctacatggtgaggtcaaccagagaagatgatttttaagttgggccttgaaagcacattaggattttgctgggtataactgggaaggagtggcattccaggcagaaagaactgagtgagcaaaggtcagggttggggttggtatgggcagttggttgtatgtgatacggcgtgtagtcaggccagtgttgccagaacacggggtcagagagcaagagcaaaggaggtaaggctaaaaggcaggctgcagtttatggcagccacgaacacatgccattcaaaggacctgttgcatggagtgcagacagctgacaggctgcagcctcggatccacaccattcaagtcagaccatgttgcctcctgggtggcccccagccaatgacagaacatggcagggttgctcgggcctgtccatttctgcccaaagtgcgactcttctcctgggcaatctttggctggaactccccactgggctcgttgagacactcttacagccgcatcacagtctgatgctctttcaacagaattatccttccctctcttgcgtcccagagttagatctggactgcagtctgaaagctgtcttttctctccgtacttctgctcctttctcctttatctttcataggcattagctcttcttacccccaataaatcttctgcacttttc

SEQ ID NO: 1188 - DNA, 700 bp, Homo sapiens
tgggctcgttgagacactcttacagccgcatcacagtctgatgctctttcaacagaattatccttccctctcttgcgtcccagagttagatctggactgcagtctgaaagctgtcttttctctccgtacttctgctcctttctcctttatctttcataggcattagctcttcttacccccaataaatcttctgcacttttcattctgttttggtgtctgcttcccagaggactccaactgagaaggagcttagatgaatgtttgggttttgctgacagtgaggagccactgaggtattttaaacagggcaagccatggtcagatctgagtttcataaaagcaattctagcactagggtgaagagccggggggtggggagacagggaagcaacaggcaatgaaaagaccatttaaaaggacactgcactgattggtacaaggtttcaacaaggggcaactggaagtatatacaacttactatgtatataccctttaactcaacagtctcaattgtagaaatctattttatagaaacactagcacaaatgcataaaagtataaaaatgaggatgtagtggcctataaatattatcaggacattgaaaaactttgtggtcatctgtaggggaggagatgaactagcagtacatctacgtggtggaatacataccaagcagcctttaaaaagaagacagcaggt

SEQ ID NO: 1189 - DNA, 700 bp, Homo sapiens
aacagtctcaattgtagaaatctattttatagaaacactagcacaaatgcataaaagtataaaaatgaggatgtagtggcctataaatattatcaggacattgaaaaactttgtggtcatctgtaggggaggagatgaactagcagtacatctacgtggtggaatacataccaagcagcctttaaaaagaagacagcaggtctctatgtactgtcatagagaaatatacacaatagactgctatttgtaaaaagccggttgctagccgggagtggtggctcacgcctgtaatcccagcactttgggagactgaggcgggtggatcacctgaggtcaggagtttgagaccagcctggccaacatggtgcaaccttgtctctactaaaaatacaaaaattagttgggcgtagtggcgggtgcctgtaatcccagctacttgggaggctgaggctggagaatcgcttgaacctgggaggtggaggttgcagtgagccaagattgtgtcactgcactccagcctgggcaacagagtgagactctgtctcaaaaaaaaaaaaaaaaaaaaagccagttgctgtacaaagtatatagcatgctcccattttcatgaacaaagctgtgcatacgtatatttataaagatccacatttgtttgtataaataagtctggaaagagatatatcaactgttgacagaggtc

SEQ ID NO: 1190 - DNA, 700 bp, Homo sapiens
tgtgtcactgcactccagcctgggcaacagagtgagactctgtctcaaaaaaaaaaaaaaaaaaaaagccagttgctgtacaaagtatatagcatgctcccattttcatgaacaaagctgtgcatacgtatatttataaagatccacatttgtttgtataaataagtctggaaagagatatatcaactgttgacagaggtcacctcttgaaggtggtagggctttcactttttactttctatgttgtttttattttctttggtgcttttctataatatattttctacttcttaaaatgatgaagatggttcatttctcttatcagaacacaaaattttaatttaaaaagcttcatatctacttagaaaaccatataaaaattctttatattgtatttccagagaagaaataacaaaaatctcctagaatcgttgagagggctgtcagcggcctggtctcggtaaagagaaattagagatgagttggaatagagccgaacacagggtggtgaagacagaagttccagaagaagccaagagtgctatcttgagtagtgggcaggtgacccacagaagggcggtgggtgggaagtaggagtgagaggggtctgtgctgaatgtgccagccttcaggaggctcaggccaggacagggtgtataaacaagaggtgacgctggctcctgctttagaactcaggaga

SEQ ID NO: 1191 - DNA, 700 bp, Homo sapiens
acagggtggtgaagacagaagttccagaagaagccaagagtgctatcttgagtagtgggcaggtgacccacagaagggcggtgggtgggaagtaggagtgagaggggtctgtgctgaatgtgccagccttcaggaggctcaggccaggacagggtgtataaacaagaggtgacgctggctcctgctttagaactcaggagagtatttaggcctaaacacttatgacctacaaaagattaaaaacttaccaacagtactcaccaatggactaaaacgctaattgtaaacagtgaagtcattgaaaaaccagaaaaatattggtgaatacttatctaaggggggaagaattttggataaaagagcaaacagcattttaaagaaattttagccatattaaaaacaaacaccaagactttaaaaacagaactcataaacaaaatcaaaagacaagcaaaaacaaggaattatatttacagcaacactgacagaaaggacatgtccttcatatataaaaaacatatggttgggtgtggctcatgcctgtaatcccagcactttgagaggccagcatgggtggatcacttgaggtcaggagtttgagaccagcttgggcaacatggtgaaaccgtgtctctactaaaatacaaaaatttagctgggcatggaggcttgcgcctgtaatgccagctactcaggaggt

SEQ ID NO: 1192 - DNA, 700 bp, Homo sapiens
ccttcatatataaaaaacatatggttgggtgtggctcatgcctgtaatcccagcactttgagaggccagcatgggtggatcacttgaggtcaggagtttgagaccagcttgggcaacatggtgaaaccgtgtctctactaaaatacaaaaatttagctgggcatggaggcttgcgcctgtaatgccagctactcaggaggttaaggaaggagaatcgctggaattgaggaggcagagtttgcaatgagctgagattgcaccactgcactccagccaaggagacagagtgagacttcatataaaaaaaaaagcaaaaaacaaaacaacaacaacaacaaaacccaaaaaacacagatgagtttgtaatcagtaataaaaatacactctccaaagaaaaacagcactggagctgggcatggtggtatgtgcctgtaatcccatctactcagggggccaaggtgggaggattgcttgagcccaggagttcaaggccagcttgggtaacacagcaagatcccatctctataaaaaataagttagccaggtatggtggtgcacacttgtagttctagctactctggaggctgaggtaaaaggattgcttgagcccaggagttcgaggctgcagtgagctatgattgtgccactgcgctccagtctggttgacaaagcaaggccctgtctcttaaaaaaagaaaga

SEQ ID NO: 1193 - DNA, 700 bp, Homo sapiens
ggtaacacagcaagatcccatctctataaaaaataagttagccaggtatggtggtgcacacttgtagttctagctactctggaggctgaggtaaaaggattgcttgagcccaggagttcgaggctgcagtgagctatgattgtgccactgcgctccagtctggttgacaaagcaaggccctgtctcttaaaaaaagaaagaaaaagaaaaacagcattgattatggtattgtgtattataaacattattttgtattggttagaattttgttcagttacataaaacagaaaacaatagtggcttaagcaagatgggattttctttctttctctcactgaaaaaaaaggtctagaaatgatcagttcagggctggtttggtgacttcaggtgtcaccagggacctacgcttcttctggctcatcctgcccctattcctaaagtgcagctctcattctcatgtcttgtggtagttgctagagtgatagtcaccacatcctcatttaagaaagtaggatggagaaaggagggtgaataaagggcacaccccctcctgttaaggagctggcttcgaagtcccatatgacacccacttgcatccattgtccggaacccagccacatgatcacactttgctgcaaaattgccaggggaacgtagttttcagctgggtggaaaagggatcagcaaaaaattggttttg

SEQ ID NO: 1194 - DNA, 700 bp, Homo sapiens
tttaagaaagtaggatggagaaaggagggtgaataaagggcacaccccctcctgttaaggagctggcttcgaagtcccatatgacacccacttgcatccattgtccggaacccagccacatgatcacactttgctgcaaaattgccaggggaacgtagttttcagctgggtggaaaagggatcagcaaaaaattggttttgttactaagaaagagggaatggatactgtagagcaatgagcagtttctaacatacatgtgaacaaaattatcaaaagaaatacaaatgtaaaagatttcagggtcaaccttaccaacagtcaaatataagtaaagcaggtggccttttatggtcttgtctggctaaggtattgaagagctggccagacaagtcatgaagacagtcaagaactgactgtcttcataaggaccgactgtcttcataagaaccttgggacaatgcacatgaacagaacagagtttcagggtaaaaatggccctttctccccaactagatggctcaaggacccaagggccacttcctggctgttcccccaaagtctccctccaactcccaagtgacatcagattctgtaaatgctgggaagtagagaaaaattctgtacccagggattctctaactaaactatggctaaaattaaattttaggtgtttttgaaagttcctttaaaaaagtaata

SEQ ID NO: 1195 - DNA, 700 bp, Homo sapiens
tttctccccaactagatggctcaaggacccaagggccacttcctggctgttcccccaaagtctccctccaactcccaagtgacatcagattctgtaaatgctgggaagtagagaaaaattctgtacccagggattctctaactaaactatggctaaaattaaattttaggtgtttttgaaagttcctttaaaaaagtaatatcctcatgcaaactgaatcagcagtttcagaacttaaaaaaaaaaaaagaacctctgtcgtattcttggggtatcacaaattaaacatgaaaaccagccactaaaataaggaccagtgtttggatactacatgggggtgatgttaggcaacctcaagttatgtcttttggcagattcaggactttatgtgagctcccacagatggtgatgtcaatgccaccacccttcagaaggcacagagaaggaaagtgcagaggacacggcaagtgtggattccacaggcttctgaagttcataggcctattttgaatagttattgtgcctttctcaatccagaccagcatcagttacctctcacgatttatttgaaagcatttacttctagtgtttgctctttttaaatggttgctgattgggaaaaataccagagtaaactgatgtttcatgaagtctgggggagacgatctttagggcatgggaagcaatatgatataatgac

SEQ ID NO: 1196 - DNA, 700 bp, Homo sapiens
gcctattttgaatagttattgtgcctttctcaatccagaccagcatcagttacctctcacgatttatttgaaagcatttacttctagtgtttgctctttttaaatggttgctgattgggaaaaataccagagtaaactgatgtttcatgaagtctgggggagacgatctttagggcatgggaagcaatatgatataatgacgaaacgtgcccatgctttggaatcagaaacacctggatttgagacctagctctgtggtttaccagctgtgtgttctgggacaagttattaaacttctctggggctcaggttccttgtcttaagatgggctaatacagtgcttacctcgttgtatcatcaagttgggtaggaaacagatggtgaacttggactgggactgtttacaaaggtgtggggagggctcagggaaatcaagatgagacagtgaagcatatgggggctagcaacaatggggagctgttaccacttgtaacctgaaggtatgaaggaagggaataaatgggtaaggggacccaaaggaggcagctattggaagggtgtctggcaggagctgtgggctccagtggaggatgcagttggcctaaagcgacctgatagggacccgggggaataacttaaccacttgccctcctcggggaactcctgacctcatcttcctgagtccttccatctcttgcta

SEQ ID NO: 1197 - DNA, 700 bp, Homo sapiens
ggtatgaaggaagggaataaatgggtaaggggacccaaaggaggcagctattggaagggtgtctggcaggagctgtgggctccagtggaggatgcagttggcctaaagcgacctgatagggacccgggggaataacttaaccacttgccctcctcggggaactcctgacctcatcttcctgagtccttccatctcttgctaatgctccccatggaccaaatctaactagaatccagaggcaagatagatgagtgatgtggcccattcaggtcagcctcccaacccagagcaggtagagaggacggagagtggatctgcaggagcaaacagaagattaatcaaaatagagactgtgatgaggttagcataatgcctggaacatagtaagtccacaagtcctcaacaaatgttaatttattttggactttggactctctgtctgcctgttttgcttattgcttacttcctggttttcatcagctcatgtatagttgagataacttccaaataatcaagtattgttatctatattggagtgttttgaaggagtaatgagtgtataaaaaagataaccagatactctggggattagagatgacagagggaaacagaggaaggggagtaagtaagagaaaaggatggagaaaactgtatgttccctatgaggctggaatgaacgcaagattatcttactttaaaa

SEQ ID NO: 1198 - DNA, 700 bp, Homo sapiens
acttccaaataatcaagtattgttatctatattggagtgttttgaaggagtaatgagtgtataaaaaagataaccagatactctggggattagagatgacagagggaaacagaggaaggggagtaagtaagagaaaaggatggagaaaactgtatgttccctatgaggctggaatgaacgcaagattatcttactttaaaatcaaatcatgcacttattgggatgtgataacagtgcgtttgcaattttacagcccagtgagacttgccagaaagggattttgcaaggaaggtcttcctgccctaaaggaaaacctagtgcttacttccagattaataagtcttaacccatcatgcctgctcccccaaaaccaagtagtcaaatgtgttaacctggatgtttaaatacctgcatgttcctgcctgggtgcctgggtcaggtgaatgttctattctgatttgggaaatggctagagtgtgttggtcgtcgcctgggatagctcccaggtaggaagggagccccagagagtggtctgaacagtgactcataaactcagtgtcctttcctccagcctttaccagctgctgacttggccccttaggaatctgtcttcattccgcaagctattctccagtgtctggttcaggctctagagcagagcattccaggctttctgtgattcctggccacctgttccatc

SEQ ID NO: 1199 - DNA, 700 bp, Homo sapiens
ctcccaggtaggaagggagccccagagagtggtctgaacagtgactcataaactcagtgtcctttcctccagcctttaccagctgctgacttggccccttaggaatctgtcttcattccgcaagctattctccagtgtctggttcaggctctagagcagagcattccaggctttctgtgattcctggccacctgttccatctccaagaccctccagcatccttctctcatttgcttaccctaccctccaggcctttgcacaggccactctctgtgcctgggacatacattctccttctggctaaccttccgcagcctccaggacctctcaggtgtcctctcctctgggagccctgctggactgcccacggggagttgggaagcccttctgtatgctcctgttagccctctttgattctctcactcacagcacttccacactgtcttggtttcctggctcatctctcccaacacactggacaccccttgagaagagacttgacatattcatcttgattttaatgccatccggcaaaattcctggcactcagagggcatgcaataaaactttactgaatgaaggtttagcgcgtaattcagaaaataagcaagaaagtgtcacaaacaccaaagcaagttaaccaagctatatgttctagaacattcttcctctcctcctgtcactctggctctcctgcgcc

SEQ ID NO: 1200 - DNA, 700 bp, Homo sapiens
gacatattcatcttgattttaatgccatccggcaaaattcctggcactcagagggcatgcaataaaactttactgaatgaaggtttagcgcgtaattcagaaaataagcaagaaagtgtcacaaacaccaaagcaagttaaccaagctatatgttctagaacattcttcctctcctcctgtcactctggctctcctgcgcctacagcagacaggacagagtctgctctttcacctgctcttttctagtcttttctttcaggtatcccctgaaatgccacttcctcagaggctatccttgactacccaatccaaagcagtcactcagtcacttgattacacttcagtctattttaatttgttagagagcacttactgctagcaccaatgttttatttctgtgttttctttctatctccaccattatgctgtagctccatttgagcagggaccttgtctgttcactactgtatgcccagcatctagtacagtgtgtggcagagagtcaagtgttcattaaatacttgttaaatgaatgcatgccactgttactgcatgctgagttaatttgatgtatggcttctatcactgctatcagattaggtgctctagagaaactcagaaagggctgagtctccttatgacattgcagggtgggagggggacctcagttcccttcctaggcctaagtgggatatgctg

SEQ ID NO: 1201 - DNA, 699 bp, Homo sapiens
agagtcaagtgttcattaaatacttgttaaatgaatgcatgccactgttactgcatgctgagttaatttgatgtatggcttctatcactgctatcagattaggtgctctagagaaactcagaagggctgagtctccttatgacattgcagggtgggagggggacctcagttcccttcctaggcctaagtgggatatgctgcctgcttgcagcttccttgtggcctggacttccccatggaggccagatgctgagcaaccccagcccatgtgtctgaaggctctgaataccgaaatgttcctctagctttctgtgagagcagttggagctgcccattgcctacactgatagaggaatgtgcccagggctcctggctggcctggcacccagcaggaggcaggcacagtggccagcacggtgaggacacatcacacttcttctttttcccatatccctatgctgagagtgcatgcagctgcctggctgggagcagaaactggcctcactttctggggcctgctgggcagacaatgcagctctctagctgtgccacagaacagggcaaatctttactagctgtggactcactccctgcccctcccattcctgcagaaattgctctaccagctcagcagagggccaggtctggaatctctcacctgtccctggcccttcctttaagccctctggtttactggaa

SEQ ID NO: 1202 - DNA, 700 bp, Homo sapiens
gcctcactttctggggcctgctgggcagacaatgcagctctctagctgtgccacagaacagggcaaatctttactagctgtggactcactccctgcccctcccattcctgcagaaattgctctaccagctcagcagagggccaggtctggaatctctcacctgtccctggcccttcctttaagccctctggtttactggaaatcataaactgtgagacacagcctttatcacaccctgaacagttcactcttaatatttaatgctggaggctaaaacaaccagggacactggaggcctcctgcttactctcagtgactgatgtttgcacctggtaattgaggtcaggttgcttctcttaagtcacatgatttgcgtcaaagcaggaaggtgtcggggccacttgttgcaaagagaccaggaggcgatcccagcaacgctgcaaaccagctttggcagcaaaggctgtgctttcatgggagccagccctaggagtgtggagctgggctggcagctggtaaatgaccctctcggggcctgaataaaccctagcttttcactcacagcaaactcaggatgccttcctccctctaaaagacctgctgaattgagtcactttcaatcctttctggagtaggatggggcattagttaattaacaaattaattaagcatgctaaatagtcacccagaagatactggt

SEQ ID NO: 1203 - DNA, 700 bp, Homo sapiens
gctgggctggcagctggtaaatgaccctctcggggcctgaataaaccctagcttttcactcacagcaaactcaggatgccttcctccctctaaaagacctgctgaattgagtcactttcaatcctttctggagtaggatggggcattagttaattaacaaattaattaagcatgctaaatagtcacccagaagatactggtcacttaagggtctccaaatcacagtataggtcccaccctacccagacacctaatcttgtttcagggtttgcttgacctcaggcatttatctcctggttgtcatggaatctgctcagataaacagcagcacaccaacctggcccctctgccagcctcagatccttctaaggcagtggagctccctggtggccaccagccacccgggctccaggcagcccaacacacactcccatgctgaggtctctcgcatgacctctctaggcacacagtaggtgctcagtaaatgctgtggcatgaaggaccctcctggagtgtctgagttctcaggcttcaaggcccctagataagcagatttctctcccctatcaccatagtcaccccagggactgcagggcaggccgaaatcagccagtgactcagctccttgggcaattcagctggcccacagaccacttcctctgctccccagcgccggatggatgcagatctgtgagtaagg

SEQ ID NO: 1204 - DNA, 700 bp, Homo sapiens
ggaccctcctggagtgtctgagttctcaggcttcaaggcccctagataagcagatttctctcccctatcaccatagtcaccccagggactgcagggcaggccgaaatcagccagtgactcagctccttgggcaattcagctggcccacagaccacttcctctgctccccagcgccggatggatgcagatctgtgagtaaggagccagctgcaggcaagcagctcgagggcaggtgggcatgatgtctggctaccactcgcactggacgccacacacacagccagggtggcagaaggccccacctgccatgtgccagtgggacaccaccctcatggtctgcgtttccaggtttccaactaaggactgagcacactctcaacatggacctcctaactgctctcgaggatggacagctggcctcaagggaacactgcaaagtggctctaggaagaagccactgtccctccagaccataaaaatggctaccaagggcagagccagcagctttcgctgtaaagtttctcaagaaaatcacagatattcccctctgtgatgttcagctcagcctggaaaggaggtaagaaagaccagactacctgatctctcaaggtcaccaaattcaaccactgtcctgtttaaaagcgggtagtacagaggccagtgtgggctctggaatgagacatgtgaagcccgggtctgc

SEQ ID NO: 1205 - DNA, 700 bp, Homo sapiens
agcagctttcgctgtaaagtttctcaagaaaatcacagatattcccctctgtgatgttcagctcagcctggaaaggaggtaagaaagaccagactacctgatctctcaaggtcaccaaattcaaccactgtcctgtttaaaagcgggtagtacagaggccagtgtgggctctggaatgagacatgtgaagcccgggtctgctgggtctgctgcacggtagcagtgtagtcttaggcattattgaaactctgtttctaaatctggttatgtgaatgaaaggggctaatttatgtaacacttttagtatactaagccctcaatatagtttagctacttaactattgtcttctttgaaggacgctgaactaaacagaagagaaacagggaaataaacagcatggcaacctacatcaacagaaacttaattattcaccctggataactgagtgtgtgagtgtgactgcaaataacaatatagcaaagagaagtttgagatctttggctcagtcattctagaatcctgagtcacagcaaatgcacagcctccatgaggctgagccacacatgaaagctgcttccacccacagactggtagaggccactgacatgcttaacgatgatgatgatgataaaaatagctaccacgggctaccacgtgcacacacatgttaagcagttcaaacaggttattttgtttaat

SEQ ID NO: 1206 - DNA, 700 bp, Homo sapiens
tggctcagtcattctagaatcctgagtcacagcaaatgcacagcctccatgaggctgagccacacatgaaagctgcttccacccacagactggtagaggccactgacatgcttaacgatgatgatgatgataaaaatagctaccacgggctaccacgtgcacacacatgttaagcagttcaaacaggttattttgtttaattcataccacaaatctttgaggtaagtattcttgttcccgttttatagaggtagaaactgagagttgaagaggctgaataatttctcaagcacactcccaactcgaccacccacaagcaaaaaggcagagctgggattcaaacacaggtatgactgtgtgtggacatctcccctgtgctatgctccctgaaggaaaattctaagtggtgttgtttctgggagaaatctacctgtgtggtctttaaacctactctgacaggagcaagggccaccactctgtatctaagaccactgggaacagtcttcaggcaacaaggtgaccagggcagctgcagagggtatctatgcccctgccccctagcgcaaaagtctgtttctctttccaaatggcccgctgggagcaactatttagggagaccatacctcctcccacactcagttcccaggcctgagccacagagtcctgccacaggagggaggacctgcctgtcctgctccct

SEQ ID NO: 1207 - DNA, 700 bp, Homo sapiens
agtcttcaggcaacaaggtgaccagggcagctgcagagggtatctatgcccctgccccctagcgcaaaagtctgtttctctttccaaatggcccgctgggagcaactatttagggagaccatacctcctcccacactcagttcccaggcctgagccacagagtcctgccacaggagggaggacctgcctgtcctgctccctccccactccaggttcctggaggcctctgtgatgattccccaggaaggactacaggatctggcaggcagcaggtggcggtgggaggaggagagtcctgggagcacagcactcctaaccccctctgcctctcacagaacaaagagggagtcatgccatgtcccctgctcccacaaatgccccacccagaggggctaatgcctaggattgagggtcttgtgtgctgaggaagtcctgtcccccaatcccctacaaaagccagaaccagctactaaggggttagacacagacagaactgtctatattaacatttcctcctaaaaaacaacaggaatcctggggaaagaccactggcctgggactccatgagccctggcttctatctctggctttatcaggtgaccacaggcaagtcacctagcctccatggtctaggccctcctgcctgttgggtgggaatcattacatatcacaatcattacagctgaccttcagggaggct

SEQ ID NO: 1208 - DNA, 700 bp, Homo sapiens
atattaacatttcctcctaaaaaacaacaggaatcctggggaaagaccactggcctgggactccatgagccctggcttctatctctggctttatcaggtgaccacaggcaagtcacctagcctccatggtctaggccctcctgcctgttgggtgggaatcattacatatcacaatcattacagctgaccttcagggaggctgtactctgggtcaggaattgtgttgggtgcattatcatatttattctcacagcaccctttgcagtagctactattttcatacccattctcagatgaggaaactgtggaacaggctggttaggggacatgcccaaagtgacaaacttagcaaaggtggacctggcactcagtaccacatctgtttttccatgctcttaaccactgtaacatacagagcccttttacagagatcaaggacagaggtaaaagtgttttgaaagcaaaaaaaaaaaagcggggaggatgcataaaataaacataaatcaccccctgccccgcccagacataattcagggaagagtcctaacccccaagaaccttctgtggaacttattcgcaacatcagagacctccaacatagaaatgaccctcaataagtcatttctttcttcctctttcccttcaggcaggaataatataactaactgaattatacaggtgagaccacgaaggtcaagca

SEQ ID NO: 1209 - DNA, 700 bp, Homo sapiens
taaatcaccccctgccccgcccagacataattcagggaagagtcctaacccccaagaaccttctgtggaacttattcgcaacatcagagacctccaacatagaaatgaccctcaataagtcatttctttcttcctctttcccttcaggcaggaataatataactaactgaattatacaggtgagaccacgaaggtcaagcaagggtgaccagcttaggcccctggctggcaggtaaggaggagactgaccccagcctcctggctcctaggggaggaaacagtgatgacaaaggcccctttgcatggccaaggtggagccctttctaccaaagtttaaacgttttagtataatatccaagtgcatcttttccaaccttaaaaacatatttaatttccttataaagctggttggcactctcctcctcctccaaagctctgtattaggcagggttcatagttgtagacaacagaatgaacagtggttagttcagccagaaaagggatgatataggaggatactgggttgatcaaaggctctctgggagggctgcagatttagagccagtcagccaggaacgatgcctgaaacataccttagagctggagaaagaacaaaaccctacctttcttcaatagctggcaaggtggcaaggtctggccccatgcagcctgggctcttcccactctcctctctccctaa

SEQ ID NO: 1210 - DNA, 700 bp, Homo sapiens
gggatgatataggaggatactgggttgatcaaaggctctctgggagggctgcagatttagagccagtcagccaggaacgatgcctgaaacataccttagagctggagaaagaacaaaaccctacctttcttcaatagctggcaaggtggcaaggtctggccccatgcagcctgggctcttcccactctcctctctccctaatgcgttgccctactcgctgcttcccaggcaatcccacctcaggtctatgaacttgccattccctctgcctgcaacctagacattcacattgctagctccctggctagctcaaatgccaggtttctgcacaaatgctcctccttagagaggccttcctggacctctaggtctctggccctagtactctatcccctctccctgctttcctcttctacttcactgctccttaacattgtgttatacattgtctgtctccccaactggaatgtaagtggcaccagggcagggacttgggttgttttgttccttgctgtaagcccagggcccagggccagacctggaacaattaggtgctaagttatttgctgaatattctatgaaggaatgacaaaggaatgcataaagaacttcaaagttcaactcctcgaacttcaaacttcaaatccccaactcctcctgcctatgctggacgattagggcagtaacaggagtcaacttg

SEQ ID NO: 1211 - DNA, 700 bp, Homo sapiens
ttttgttccttgctgtaagcccagggcccagggccagacctggaacaattaggtgctaagttatttgctgaatattctatgaaggaatgacaaaggaatgcataaagaacttcaaagttcaactcctcgaacttcaaacttcaaatccccaactcctcctgcctatgctggacgattagggcagtaacaggagtcaacttgtgctgtgctgtcaccttgcctggatccgcatcagccctgcagctcccactttggaggagacttgcccagggacctacagctctgaagcttctctgacagcctctgcagctcttggaacttatctgggctgctgctgtgcagaccatggatgcgtagctgagttcctgcccctgatttcctagagtctcagaaagacagggaagtgacttacccaaagtcccctttcaccctataaacagttcagcccagggagtgaggctgacacgcaaatgcagctatgtatagactcagagtcatccaaggtcagggctgggtggagccttggtcacatgcaggccaacctgtgtctggagataatgcaagccagtgcaggggttagcgtgtacatggactctggagtctggcagatctaagccccacccaccaacctgtgaccttggagaattatttgaaaagacattatttgaaaagcagatgtaaaatggaaataaaagttcct

SEQ ID NO: 1212 - DNA, 700 bp, Homo sapiens
caaggtcagggctgggtggagccttggtcacatgcaggccaacctgtgtctggagataatgcaagccagtgcaggggttagcgtgtacatggactctggagtctggcagatctaagccccacccaccaacctgtgaccttggagaattatttgaaaagacattatttgaaaagcagatgtaaaatggaaataaaagttcctatttaaaacagtcagttgtcccccattcagaagcctattacagttgtccctcagcatcttcgaggaattggttccaggacagctcctcagataccaaaagccacgatgctcaaattccttataaaaagtgacgtagggctgggtacaatggctcgtgcctgtaatcccagcactttgggagaccgaggtgggcagctcacttgaggtcaggagttcaagaccagcctcgccaacatggtgaaaccccgtctcctctaaaaatacaaaaaataggcgggcttggtggcatgcacttgtagtcccagccactcgggaggctgaggcatgagaattgcatggatccgggaggcggaggttgcaataagccaagatcgcaccactgcactccagcctgggtgacagagtgagacttcatctcaaaaacaaaaaacaaacaaacaaaaaatgtgtagcacagtcagccctccgtatccacaggtccacacacagaacctgctgg

SEQ ID NO: 1213 - DNA, 700 bp, Homo sapiens
gtcccagccactcgggaggctgaggcatgagaattgcatggatccgggaggcggaggttgcaataagccaagatcgcaccactgcactccagcctgggtgacagagtgagacttcatctcaaaaacaaaaaacaaacaaacaaaaaatgtgtagcacagtcagccctccgtatccacaggtccacacacagaacctgctggtatggagggccaaccgtgcttcctattcttttttttttttctttgagacagagtctcactctgtcacccaggctggagtgcagtggcacaatcttggctcactgcaagctccacctcccaggttcacgccattctcctgcctcagcctcctgagtagctgggactacaggcacacgccaccatgcctggctaattttttgtatttttagtagagaaggggtttcaccatgttagccacgatggtctccatctcctgacctcgtgatccacccgcctcggcctcccaaagtgctgggattacaggcgtgagccaccgcgcccggccacttcctattccttatggtatcaaattcaaactccttggcttgatagtcaaactctcaccacgactgaaatctggttaaccaacctgtccaatacaatctctctgcactcctccaaataatgttcaagttggacctaagtgctccctagtccttctcacacctgtgtgcctgga

SEQ ID NO: 1214 - DNA, 700 bp, Homo sapiens
tacaggcgtgagccaccgcgcccggccacttcctattccttatggtatcaaattcaaactccttggcttgatagtcaaactctcaccacgactgaaatctggttaaccaacctgtccaatacaatctctctgcactcctccaaataatgttcaagttggacctaagtgctccctagtccttctcacacctgtgtgcctggaaacaccacccaccttcttttctctcatctgaatttactagagccccagaggcaggtctcatagtcttccctgacttgggtttttttggcactgactactgggcattcatgatgggacctgcccctggggctctagtatttggtgttacagggaggaacacagttttgattccccaaacagaacaaaggatccttgagggcaactgtctgttgtcatttcatgtctcccccaaccaggcattaaaacacgcatagaaattcctgctgacgggctcttgtgaagttacaagttacaatttggtgaaaatgcccccaagtatttcctctatttcccaaggaaaggaaaagaaagatatagaaattaaattaaagacaaacttaaatcattcccatttctgcatgcttggtctgtgtgggaaaaaaaaatcatttcatctctgtctgcaacgcagacttgacaagttgagaaactccctaaaaacaaagcatacaaaaaaaaa

SEQ ID NO: 1215 - DNA, 700 bp, Homo sapiens
ggtgaaaatgcccccaagtatttcctctatttcccaaggaaaggaaaagaaagatatagaaattaaattaaagacaaacttaaatcattcccatttctgcatgcttggtctgtgtgggaaaaaaaaatcatttcatctctgtctgcaacgcagacttgacaagttgagaaactccctaaaaacaaagcatacaaaaaaaaaatcataccaattagtctcacttaaaggtttcaggaaggaaaacacagttaaactgaaaacggttaactggtgtttaaaaaaaagaaaccagcccggaaatgtttttaggactgcgtctatcgaagtcccttagggactgatttgtccttcaatatattcatagcacctgctttcaccaaaacccagcagcccaacgctagagctttgtgagtgagatgcagagtggaactggacatggagctacacagctctgaatcatgttccccaacagcaagcaacagccacatgaaggattcctggcagtgccctctagccactacagtgggccatgggaagccgtacaaacagcaaatggcatcctgcaaccccagcttctccttctgccgcattcctctctctgtccatgcctctgcttccccattggcccactggccaaatacactcagaaaaaagtccatgcacaagcctccacccaaattaattccacattctttcaaga

SEQ ID NO: 1216 - DNA, 700 bp, Homo sapiens
ggcagtgccctctagccactacagtgggccatgggaagccgtacaaacagcaaatggcatcctgcaaccccagcttctccttctgccgcattcctctctctgtccatgcctctgcttccccattggcccactggccaaatacactcagaaaaaagtccatgcacaagcctccacccaaattaattccacattctttcaagagaggccttgaaaggtactgaaattcagggaagctcttcactagacccctcactggaatgccaagaagtgatgtagtggcccttgacataagggcttattcccatttatgaaactgaaattattttattctaagcacaaagctaacaaatgtgatcaaaacagaaaataaacaatcctcattcaagtgctcagaatgcagcacaaataggatcttgggataaataagatagagctgtgaaattaataggggtgagaagaggggagggtcagcgggagaagtccaccaaggggctgaaaggcctgtgcaggcagacggaaaccctgggttcttaggggccaggcatgacagtgcagaatagtccaccctgggagtgactggaagaaggactgcagggtccccgtgaagaacacctcacactcccagcttgccacacacttgttgaactattctgggtggatacctcctacctggatggcaaaggagacaggcccaagatgc

SEQ ID NO: 1217 - DNA, 700 bp, Homo sapiens
gcctgtgcaggcagacggaaaccctgggttcttaggggccaggcatgacagtgcagaatagtccaccctgggagtgactggaagaaggactgcagggtccccgtgaagaacacctcacactcccagcttgccacacacttgttgaactattctgggtggatacctcctacctggatggcaaaggagacaggcccaagatgcagaagggaagggaagtcacacttacaatgcagaggatgcgcccttgtccctcatactctctgaaacattgcaggaataattctggtttcactgctattgtttgttgtttttgtaaataaaccgcaaaaatcaacaaatggcctcaaaattgaacacatgtgatttacaccaattcatatatcaaaacacaaataatgcagaacaaattagagaaaaactccagtcaggctctccactcacccatggctggtggctggcattcaactctccagcagccagggagtccattttcttgtttctctgctggccatcctcaggacttgcggcggggagtggggggcccagggtgtgctgccacctgcaggccaaacaaggaaaaaacataagcaacggccacaatcatccgcctgaagcccctcctatatcctcaggccgctggaagacctggatgcccgtcgtgggacaagagccagaagcactcacccagtgccaacacctg

SEQ ID NO: 1218 - DNA, 700 bp, Homo sapiens
ctctgctggccatcctcaggacttgcggcggggagtggggggcccagggtgtgctgccacctgcaggccaaacaaggaaaaaacataagcaacggccacaatcatccgcctgaagcccctcctatatcctcaggccgctggaagacctggatgcccgtcgtgggacaagagccagaagcactcacccagtgccaacacctgctgggccacaaacagtttctgcttgggatcccaacacaggcagcagagtcagcaaaaactctaagatatcaagaagtcaagcatttcttaacaacagcagcaaactcttacacagggctgtggttaccagacactgctctaaataacttacacttgtttacttatttcatcctcacaacaacgggtaaatattttaggtctctgccaatttgcctgattactgaattaggttgaatcattaaaatgaataacttgataatacccaatttcaaagaggggtcacatatgaaaactctatgagagattctcagcatcttgcagacattcattccctaaatattcattgagtgtttgttatggacgagacactgttctaggacctgggaagagaggagcgaacacacaagacaaagtccctgttctcacgaagcttctgttccagtgcggggaggcaacagtagaaaaggagacaaatgccatgcagaagaaaaagcaggga

SEQ ID NO: 1219 - DNA, 700 bp, Homo sapiens
gagagattctcagcatcttgcagacattcattccctaaatattcattgagtgtttgttatggacgagacactgttctaggacctgggaagagaggagcgaacacacaagacaaagtccctgttctcacgaagcttctgttccagtgcggggaggcaacagtagaaaaggagacaaatgccatgcagaagaaaaagcagggaaaaagagatagagcacaatgacaatgctgttaatacccattcatttattcacttatttccaaggacttactaaccatgtcatttcttgcccacagctgcatgccaggcactatgccagataaaattgtgggtaagaaatagacatggtctctgcctgtatggagtacttacataagaggaacatctattattagtcaaataatcacctaaataaatgcaaagatgttaatctgtgataggtgtgatagcagaattgcatgtagtccttgtgagagcatctcaaggaggcctgaccttgtctaaggggaggcctgaaatggagtgtggggaggagcaatgtgttagtccattttgcattgctataaaggaatatctgaggctgggtaatttataaagaaaagaggtttaaggcggggtgcagtggctcacacctgtaatcccagtactttgggaggctgaggcaggtggatcatctgaggtcaggagttcgggaccaacc

SEQ ID NO: 1220 - DNA, 700 bp, Homo sapiens
tctaaggggaggcctgaaatggagtgtggggaggagcaatgtgttagtccattttgcattgctataaaggaatatctgaggctgggtaatttataaagaaaagaggtttaaggcggggtgcagtggctcacacctgtaatcccagtactttgggaggctgaggcaggtggatcatctgaggtcaggagttcgggaccaacctggccaacatggtgaaaccctgtcgctactaaaaacacaaaaattagctgggtgtggtggtgcacgcctgtaatcccagctacttgggaggctgaggcagaagaattgcttgaactggagaggctgaggttgcagtgagccaagatcgtgccaccgcactccagcctgggtgacagagcgagaatccgtctcaaaaaaagaaaaagaaaagaaaagaggtttggctcacagttctgtagactgtacaagtgtggcaccagcatctgcttggcttctggtcaggcctcaggatgctcacaatcatggtgaaaggtaaagggggagctggcatgtcacatggcacaagaaggagcaagaaaggggaggaggtgccaagcctcctttaaacaaccagctctcgcctgaacagagtaagaactcactcattacctcggggagggcaccaaaccattcatgagggatccagccccatgacccaaacacctcccaccaggcccca

SEQ ID NO: 1221 - DNA, 700 bp, Homo sapiens
aatcatggtgaaaggtaaagggggagctggcatgtcacatggcacaagaaggagcaagaaaggggaggaggtgccaagcctcctttaaacaaccagctctcgcctgaacagagtaagaactcactcattacctcggggagggcaccaaaccattcatgagggatccagccccatgacccaaacacctcccaccaggccccacctccaatgctggcgatcacatttcaacatgagatttggaagagacatgcatccaaaccatatcaagcagtgtccctgtcaaaagcacaccctgtgcacaggctggatcatgggtagttggcagggacaggaggcagggtgaagctggagaagcagtgtaggtgacccttgcatgacactcccagccacaagaggagttcgagccttaaccctggagaactggagcaccacacaagggtcttaggcagaggattaatgcatttagatgtgtacttttaaaagattatctatgtaggctgagtaatggccctgccaaagatgtctatgtgtgaatccctggaggttgtgtgtatgttcccctatatggcataagggacattgcaaatgtgatcgagttaagggtcctgagaaccggagattatccaggtgggcccaacataatcacaagtgtccttataagagggaggcagggggagatctgacttcagatgaggagcct

SEQ ID NO: 1222 - DNA, 700 bp, Homo sapiens
gagtaatggccctgccaaagatgtctatgtgtgaatccctggaggttgtgtgtatgttcccctatatggcataagggacattgcaaatgtgatcgagttaagggtcctgagaaccggagattatccaggtgggcccaacataatcacaagtgtccttataagagggaggcagggggagatctgacttcagatgaggagcctcagaatgatgtggcacgagaaagacttggcttcgaagaggaggaaggggccctgagccagggaatgcagtggcctctagaagctggaaaaagcaacaaaacgattctcctctagagcctccagaaggaacgcagccctgccaaagccttaatttcaggacttctaaaagagtaaatttgtgttgttttaaggcactgattttgtggtaatttgttacagcagcaataggagaataggacatactagctcctgtaaaaaaccagactggacgtaagggcgaggcgaggcagggaccagctagaggtcactgctgtggtccaggcaagaggtgtgagagcttgcaccacagtggtggccgtggggatggagaggagtggtgcagttgaaggaccccagcaggggaagagctgaccagtcaaaggtctcgctgcaatctggcagatgttactggaatgccacaacaggcctctttcaggctcaggccctggctggctcaccc

SEQ ID NO: 1223 - DNA, 700 bp, Homo sapiens
tagaggtcactgctgtggtccaggcaagaggtgtgagagcttgcaccacagtggtggccgtggggatggagaggagtggtgcagttgaaggaccccagcaggggaagagctgaccagtcaaaggtctcgctgcaatctggcagatgttactggaatgccacaacaggcctctttcaggctcaggccctggctggctcaccctggctacagcccagcagctttacagaaggaggaagctcacaccagggctgtagaccactcccaggcagatgcaccatttactcacttaacctgccaaccccattcccacaaaaaagttcaagagtctccaggaacaagccctaagaaagaacacgtggggaatttttactaggcaaaaggtagcaattatttctgccaagcattaagccttgcagcgaactttttttttttttccgtgaacagagattttgtaattctggaagagaggtgtccagatttaaatatacacatctccaacacaggtgatacagaaccatgattaaatctaacatctaaaaacttcatggtcagcagaaaatgcagaaattaaagaaagactaaacaagaaactaggagactcagcgtctactctattcttgcttaataatccagacctacttaaaaaatgggatcctaatttggtcctgtttaatggagctgtcaagaagaaaaagcaata

SEQ ID NO: 1224 - DNA, 700 bp, Homo sapiens
acaggtgatacagaaccatgattaaatctaacatctaaaaacttcatggtcagcagaaaatgcagaaattaaagaaagactaaacaagaaactaggagactcagcgtctactctattcttgcttaataatccagacctacttaaaaaatgggatcctaatttggtcctgtttaatggagctgtcaagaagaaaaagcaataaaaattattcgagagaattttagaaacattctcccattctactccaaaaatataaatatgcacactccaaaaccaagtaccttggactgtactgagagatgacaatgacgtcttaaccgtactatttccccatgatgttgcagcaggccacagggacctaactgaattgtaagaacatgaaaggacccaggaatgcctgcagatgacaaaataccaggtagtcctgtcagtgtaggagcatgttaatttaaaaatagatatatttttctggtgacaaaagtgacatgtctattactggaaaacacaaacaactcctgtagtccaatgatccagagataacccatttggaaatattttcttccagtcttttttccccattgatttcggcacaggcgcgcgcacacacacacacacacacacacacacacacacactcatacttcatttttaacaaaattacaatactgtatatacttttataaccagttttatataacag

SEQ ID NO: 1225 - DNA, 700 bp, Homo sapiens
aaaacacaaacaactcctgtagtccaatgatccagagataacccatttggaaatattttcttccagtcttttttccccattgatttcggcacaggcgcgcgcacacacacacacacacacacacacacacacacactcatacttcatttttaacaaaattacaatactgtatatacttttataaccagttttatataacagtatataatcctccatgtattaaatacagtttttcataatgctagtattccatcatatgaaagtaggaaaatcacttaaccaatccctaattgctgaacaactgagtagtttctaactttatggtaacataagtcattgggaggaacctcctcatctacgggaatatccctagatataaatctatgtctatagctctgattatttccttagggtcctatttcctacatccatgcattgccattactattttgctataattaattaccatctgtaatgtacttaacatttctctttacatcaactcatttctgtccttaaacaaatgtattttaaaagcaaacctgactcggtgtagtggctcacacctgtaatcctagcactttgggaaaacaaggcaggcggattgcctgagctcaagagttcaagaccagcctgggcaacatggcgaaaccccgtctgtactaaaaatacaaaaaatcagccgggtgtggtggtgcgt

SEQ ID NO: 1226 - DNA, 700 bp, Homo sapiens
caactcatttctgtccttaaacaaatgtattttaaaagcaaacctgactcggtgtagtggctcacacctgtaatcctagcactttgggaaaacaaggcaggcggattgcctgagctcaagagttcaagaccagcctgggcaacatggcgaaaccccgtctgtactaaaaatacaaaaaatcagccgggtgtggtggtgcgtgcctgtagtcccagctactcaagaggctgaggcacaagaatcgcttgaacctatgaagcagaagttgcagtgagccaagatcatgccactgcactctagcctggacaacaggacaagactctgtctcaaaaaacaaacaaacaaacaaacaaaccttatttaagtggaaaaccaacatcatatgccataaatgaaggcaatcataataggttttattggaataaaaaaacactgtggttaaaatatagtcaaaatactgctacccctttgcccattcttttatataaaatgggagattagagaggcttagagaggtgttaaaggtatgctagcaccaagctaaagtttttcaccttccgttgatcagaagactgaaaaggaattgagcatgggaataactttctcactgtgagtcagtgttagacaatgtggcaaatgtgtcccaactagaattaccctgcgccacctgaaataacctcatatgaaaacatgccttagg

SEQ ID NO: 1227 - DNA, 700 bp, Homo sapiens
agagaggcttagagaggtgttaaaggtatgctagcaccaagctaaagtttttcaccttccgttgatcagaagactgaaaaggaattgagcatgggaataactttctcactgtgagtcagtgttagacaatgtggcaaatgtgtcccaactagaattaccctgcgccacctgaaataacctcatatgaaaacatgccttaggacatattcctggaagtagaactgggataaaaggcatggacactttaagcagcttctgataaccacagcccaaacaccatccaagttagttttaccacagttttactatgactgtgtccattttacttcacgttcacaaatattaagtactataaacaaaatattaaaatagttaaaacgtttcagctttttgatgtaaaatatccagcagctgaatcttcaaaggctattttcatgctcttctagctagtccctgaccctagggcagggctattttatgaacctttaattagtggtaagcttacaacaaactgatactgcacttggtttcaccaagctgaagtaaactctgtaaaagatgaggaagtgactttagcatttgcaaatatttcagaatgcctttgtgccagcaaaggtcaaacaacgatcagaattgcatggattccaaagtatacttttgggaaataagagactcagagaagcattactcaagatacaat

SEQ ID NO: 1228 - DNA, 700 bp, Homo sapiens
gcttacaacaaactgatactgcacttggtttcaccaagctgaagtaaactctgtaaaagatgaggaagtgactttagcatttgcaaatatttcagaatgcctttgtgccagcaaaggtcaaacaacgatcagaattgcatggattccaaagtatacttttgggaaataagagactcagagaagcattactcaagatacaattcactatgaattttcagcaattcaatgaaaagtctaaaagaaatacatgtttaaactttcctatcctggtataatatgcaattgcacaaataggttagattgtagattaatgcaattgttaatatttctaacatagaaaaaggaaattgtattttgaagcaagaagaattaataacaattggaattgttcaggttattttaataattcccaggcagatacctatgtgtatatgtgcctgtggggaaaaggtaaggaaaaagagacgtgagaaaacatacttatgtaattccagcactttgggaggctgaggcgggtggatcactaggtcaagagattgagaccatcctggccaacatggtgaaaccccgtctctgctaaaaatacaaaaattagctgggcatggtgggacctgtagtcccagctactcgggaggctgagacaggtgaagtgcttgagcccgggaggtggaggttgcagagagctgagattgtaccactg

SEQ ID NO: 1229 - DNA, 700 bp, Homo sapiens
tgggaggctgaggcgggtggatcactaggtcaagagattgagaccatcctggccaacatggtgaaaccccgtctctgctaaaaatacaaaaattagctgggcatggtgggacctgtagtcccagctactcgggaggctgagacaggtgaagtgcttgagcccgggaggtggaggttgcagagagctgagattgtaccactgcactccagcctgggtgacagagcgagactccatctcaaaaacaaaaacaaaaacaaaaaataaaaaaaaagatttattatgtttggaaggaggttataggttctgattaatttttgccagagacaaaaatacaagtttatctaagcttaagaactaaatgatggcctattgtaagatatagaacttccaactcactgaataaaaagaaggaaagaagaaacaggggacaaatacactttgatgaatccatagagtcacaaggaaaaaaaaaacacacatgataaatacatggcaaaacaagatggcaaaaataagaccacatttatcagtgatcaaaataaatatgaatgaattaaattccattgttaaaagaccaagactttcaccctaaatgcccataaatggaaaatggataaattatggtatgtattccattttaatggatgtgtatgtgtgtgtatgtatgtgtatgtgtgtgtatacaccacagaaagaggcc

SEQ ID NO: 1230 - DNA, 700 bp, Homo sapiens
aagatggcaaaaataagaccacatttatcagtgatcaaaataaatatgaatgaattaaattccattgttaaaagaccaagactttcaccctaaatgcccataaatggaaaatggataaattatggtatgtattccattttaatggatgtgtatgtgtgtgtatgtatgtgtatgtgtgtgtatacaccacagaaagaggcccatgagtttcagtttagaaagatgtagaaatatatttgtataagcataggaaagggtccagaaaaacacaccaatatgatatctgtggttgcctataaagagcagtttacctatgagtttcagtttagaaagttgtagaaaaatatttgtataagcataggaaagggtccagaaaaacacaccaatatgatatctgtggttgcctatggaggctgaagtggactttcctgtctcactttacaaatgtctatactgtttgaatttattacaaaagcatatgactaaagaaacatgaaaaaatggaataataaacataagggcagaatcagcaaaatagaggacatagaggaccaaaaaaaaggtggttaacaaaacttgaagtatttatttgaaagtagacaaacctctagtgagactgatcaagaataactgacagaagattttttaaaaatgagattacagaaaaaggaagaaatgacaaataaaacagacattttaa

SEQ ID NO: 1231 - DNA, 700 bp, Homo sapiens
aatggaataataaacataagggcagaatcagcaaaatagaggacatagaggaccaaaaaaaaggtggttaacaaaacttgaagtatttatttgaaagtagacaaacctctagtgagactgatcaagaataactgacagaagattttttaaaaatgagattacagaaaaaggaagaaatgacaaataaaacagacattttaaaacttataaaggaataatataaacacatgataatacatttgaaaatacagatgaaatgaataatttctagacaataaaaattgccaaatttggcacaaaaatgtgaataaccacttaagagactcaaataattttgaaacctcttccccatagagtttcagacccagaagattttacaagtgcctcctactaacttccaaggagcagaaaatctctatcttaatggagttgctttagaaaatagaaaaaaagagaaaacattgcccaatttgttacttgattttgaaatgttaaatatggactgtacaaataaagaaaaatacaggatagtttcacttataaacatagatgttaaactcctaaataaaatattatctaatcaaatacgaaagtgtattacaaatacatcatgataaagtaattcaccacattagtcgattgtggaagaggttactagtgctcaccagtctctcgttcttttcctcctgggaacaccacc

SEQ ID NO: 1232 - DNA, 700 bp, Homo sapiens
ggactgtacaaataaagaaaaatacaggatagtttcacttataaacatagatgttaaactcctaaataaaatattatctaatcaaatacgaaagtgtattacaaatacatcatgataaagtaattcaccacattagtcgattgtggaagaggttactagtgctcaccagtctctcgttcttttcctcctgggaacaccaccaggctacatttcccagccaccttacaattaggtgagacccatgagactagtccatgccaatggaatgtgaatggaagtgcatctaattttctggctcatgaaaacagcagcattttctctattttctttttttctttctttgttttttttagacggagtttagctcttgttgccgaggctggagtgcagtggcgcgatcttggctcactgcaacctccgcctcccgggttcaagcaattctcctacctcagcctcccaagtagctgggattacaggcatgtgccacaatgcctggctaattttgtatttttagtagagacggggtttctccatgtttgtcaggctggtctcaaactcccgacctcaggtaatcagcccgcctcggcctcctgaagtgctgggattacaggcgtgagccaccgtgcccggcaagagcagcattttctaaaagcaatcagtactcaacaccatcctgctgaggtagggcagcggcggactc

SEQ ID NO: 1233 - DNA, 700 bp, Homo sapiens
attttgtatttttagtagagacggggtttctccatgtttgtcaggctggtctcaaactcccgacctcaggtaatcagcccgcctcggcctcctgaagtgctgggattacaggcgtgagccaccgtgcccggcaagagcagcattttctaaaagcaatcagtactcaacaccatcctgctgaggtagggcagcggcggactccatgttttgaaacttaggaacttagaccatcttttgtcaaattcagatggttttctcaaagtaaagatcattcaagttttgtttcagtaatgggccgtatgatcagatctgtgtgattaggctgaattcattattattgagacaaaaattgagttaaaggggattcttggtattggcctgcaaaacctgtcataacttaaatgtaaagtttctgatgatttagtcactttactctcagctcttagctctttcactcacctgtccttgttctacacaacctgcctgatgggtaacttgaatacatattttctctcttcaggggatgggaacgccctaagggcaggggctgtttccacagccctggggtggaacccccttcctgcataccaagaatgagttggctatacttgacgaagggcaaagacaaggtggcacgcatctttcatgcttctgctggcagatgcagtggactggaaatttcctggtctgggaaggactc

SEQ ID NO: 1234 - DNA, 700 bp, Homo sapiens
atacatattttctctcttcaggggatgggaacgccctaagggcaggggctgtttccacagccctggggtggaacccccttcctgcataccaagaatgagttggctatacttgacgaagggcaaagacaaggtggcacgcatctttcatgcttctgctggcagatgcagtggactggaaatttcctggtctgggaaggactcggtctgtgagtgcacctatccctgacatctatgctagccccgggatgggggccccagcagagtaaggccctgacttcacatggacagggccagggcaagggggccacatcctggcctagttgctctccatgcccgtgatcaagggagatgagctgccagcttgctcggtcaaggaacacttggaaggcactccaagtgcccccaggtgcaccagatctaggaaacttaagcaaactacatgaggtatggggtggggcccagtgggaaaaatgagtctgacaggtcagagggagtagattatgagctcaggttaggcattctgttcagcattttacgtacaccctcccacttttgatttttaccaacacccagggaggtcggtgctctacaaaagggaaaggcgtgctcaggtggcccgacttgccacggttccagctcgaccccgggctgctagccccttggcacgcttgtctgaggcctcccaggtcttccagcctgg

SEQ ID NO: 1235 - DNA, 700 bp, Homo sapiens
tatgagctcaggttaggcattctgttcagcattttacgtacaccctcccacttttgatttttaccaacacccagggaggtcggtgctctacaaaagggaaaggcgtgctcaggtggcccgacttgccacggttccagctcgaccccgggctgctagccccttggcacgcttgtctgaggcctcccaggtcttccagcctggcctggaggctcaaagccacgaaacccaagggtgccgcttctcaggccctccccgcccccacggcagaacccctgaccctgcccgggtcaaacgcctggcgtcgggcccgccgggtccgcaaggaggagcccgcgaggcggccgcgaaggggctgtgcttacctcgcccggcgcgggttgcggccccagggcccgcgctccaggctggcggccgctgcattctgcgcccctcgcctgaaacggcagctgcgccagtcctggccacgaccgctttcattttcctcaacgacatcggcaggaaagcgaaagcgaaaccctccgggaggcgggaccggggccgagcgcgcagtgaacgcggggcgcgcggcgggcgcgggccggcagccagaggcgggggccccgggctcgggtctgcgcgtggcctggcccggtggcgttcggggtggagctgggccagccgagtgcccgagagctagtccgccacgcacacctgcctcggc

SEQ ID NO: 1236 - DNA, 700 bp, Homo sapiens
aaagcgaaagcgaaaccctccgggaggcgggaccggggccgagcgcgcagtgaacgcggggcgcgcggcgggcgcgggccggcagccagaggcgggggccccgggctcgggtctgcgcgtggcctggcccggtggcgttcggggtggagctgggccagccgagtgcccgagagctagtccgccacgcacacctgcctcggcgggacccgggcccgggctgggcgggaggctgggcaggcccgccgtaagtggaaaggcgcccgcggcgcttcggccgaccgggacaggttcctccatctgcccttcattcagcgtttacttgggcctgtggctggcagccggcccgggacctgaccgctggcggcgcctcgggctctggcctgaggaggcagatggcagcctgagcaactgggaccaagcctctgaggagtccccgttggaggggacttgaccatgaggtaccaggcatctcatctggggtcagcggagaacccaaaagtcaatgacgtcggtgaaatgggggtcccttcatccgataagagaaactggaacagcaagcctatggtttggactccctggtctaagcggtgcccatcaatatctaaacatttagagattccaggtttcagtgtctggccgtctcttactgtcagtgatttggggcaaaatattcaagtagttagacttaattacttcccct

SEQ ID NO: 1237 - DNA, 700 bp, Homo sapiens
tcaatgacgtcggtgaaatgggggtcccttcatccgataagagaaactggaacagcaagcctatggtttggactccctggtctaagcggtgcccatcaatatctaaacatttagagattccaggtttcagtgtctggccgtctcttactgtcagtgatttggggcaaaatattcaagtagttagacttaattacttcccctgtgggatgggaataataataatcatacctactgccagaattttaggaatgaacaatagaaggaagaaaatacttaaaattttctgacagcctctaagtgggttccttgagggcagcaaccaagtcatttacctggatgcttgatagacattctctaatggccagtccatcaacttggagctatctccatgataacaggttagttgtcaaagtttggacaatattatctggagtttaaagactgaggaagccctgcaattttttttggaaggtgtctgaaacttagcctgacaattagcccccacaattatgccacggaaccaggtttttgttagagtggagcatggccacaacgtttgatggacattcctacagcggtgttcagcgctggccactgaggtctgaaaatacttttgcaagcatttctattcacttgcttttagaaaacattggtaagacaccatactccaaacacagtttgccctgtctgtacgtttgtt

SEQ ID NO: 1238 - DNA, 700 bp, Homo sapiens
ccccacaattatgccacggaaccaggtttttgttagagtggagcatggccacaacgtttgatggacattcctacagcggtgttcagcgctggccactgaggtctgaaaatacttttgcaagcatttctattcacttgcttttagaaaacattggtaagacaccatactccaaacacagtttgccctgtctgtacgtttgttgcaaagcaaacataaaagtttttgccatagagcaaacacagagcagtctgttataactggaacaagaaaccaaaatgagctattaaatctgcccagagtcactttggtttacctgtttgtaatttgggcacattccctgcaagatggaggccctggtctgtgactgatgtaggggcttgtatgtgtccttgcaatagttccctcaagagcaggtgggaaagtggggcaggccaaatgatgaccttagaaaaacaacagcctgtttctctgtccagaagatgctacttttagtctgtagtatgaaggaaaaagaaaaaacaaaaaaggcaagccttggagcctcttcctccttataggacaattcttgactccaagatagcaaagtagagttaaatctgcttctgcataaaaactatgtttgggaagatgaagatcaggaaaagacaggaagagatgtaagcagataagccaaatcctggttaccttttatagacatcac

SEQ ID NO: 1239 - DNA, 700 bp, Homo sapiens
tatgaaggaaaaagaaaaaacaaaaaaggcaagccttggagcctcttcctccttataggacaattcttgactccaagatagcaaagtagagttaaatctgcttctgcataaaaactatgtttgggaagatgaagatcaggaaaagacaggaagagatgtaagcagataagccaaatcctggttaccttttatagacatcacacatgtgaacagagagcatcaggaggtcaaggccggcctgatgtttttcatcttggcaacttcccaaggtccaggtttggtccttgactttgtggggccaaaaatctcgtctgacttccagtgtaccagagtcgattagcactgttgcataaagtcagaatgacaactgactgatttcattcactatttgctagagaagtgctatgctaaatgcattacatgcattattacctcattatttctccctactatcatgtggtatattataatctatttatttttcatttgggagaaaaaaagatgaaggaaatcccaaggtcacatggttactatgtatgttagtggcagggtttgaatcaaggccatctgaccccaaaacctgaagcttatccattcctgttagaagcaagactgtcgggaacactggactcgaggccacctgatgaacacattctcttcttgtagccatgcagtttggagccccatagtcagaaggtgg

SEQ ID NO: 1240 - DNA, 700 bp, Homo sapiens
agatgaaggaaatcccaaggtcacatggttactatgtatgttagtggcagggtttgaatcaaggccatctgaccccaaaacctgaagcttatccattcctgttagaagcaagactgtcgggaacactggactcgaggccacctgatgaacacattctcttcttgtagccatgcagtttggagccccatagtcagaaggtggcttagtgagcctaaaatcagaatcggaagagtgaattgtctgacttaaatgtttgatgatatcaggctcgggcaatgtgggatgtctctttccacaacacaggtcaaaacctataggaagtactgttcactcatccctgctggcctggccagcccttctccctagatggggcctggtggacaccatctgtttgtgtcaatgaggctctctgtattatggtacccaggccgcctctcctcagatggacatttttagatagagcaaggcgttactgagtaacattactcagtaaggtctcgcagcccttatttttctttatggagacattttgtatctttgctctgattggcttgatttataatttaacttctaaaggacagctttctatcccaccttttggagacagctctgttttccttactatccttcctgatctaaccctggaacaaaagtttgtgcagtagcaagttctgcaacaagaactttatccaggcctgca

SEQ ID NO: 1241 - DNA, 700 bp, Homo sapiens
gcagcccttatttttctttatggagacattttgtatctttgctctgattggcttgatttataatttaacttctaaaggacagctttctatcccaccttttggagacagctctgttttccttactatccttcctgatctaaccctggaacaaaagtttgtgcagtagcaagttctgcaacaagaactttatccaggcctgcactgatagtcagtaaagacacaaaagaagcaaaagtccaagtccaaggccagtcccaaaagactttactacagaatcgggcaatggagggttggggggcggggcacagctgatgatcacgcaacccagctgaagaatgatataaatggaatgaaagcatggtgcaagcagcatctaacttaggagtcactggttaggaaaaaaaaatacctgatgtgtgattcagataaaaatgaaaaaaataacccttttagatatttcattcaacaaatattctgtggcaactacaaaatgcagccaccctgctaatgctggggattcagtgatgagcaaaaataaatgtggtctctgccctcgggaaacacacttgagtgaggtaataaagcaatcaaataattggtcaaatatagaatgccatcctaaatactacaagatgcgtttgacgctataagagggaatgccagaggcaaaactcctctaatgggccacctgtactctggg

SEQ ID NO: 1242 - DNA, 700 bp, Homo sapiens
ccctgctaatgctggggattcagtgatgagcaaaaataaatgtggtctctgccctcgggaaacacacttgagtgaggtaataaagcaatcaaataattggtcaaatatagaatgccatcctaaatactacaagatgcgtttgacgctataagagggaatgccagaggcaaaactcctctaatgggccacctgtactctggggcttcctgtcagtctggccagcactttctcagaatggctctgcagtctgaggctcttcctatctactcctccatccttccctcttctctttcacaggggtcagacctgcattacggtgtggggctctctctgcttactcttgcttctgctcctctttattcttcataggcattttccccaataaactcttccaggtttaattccatcttggtgtctgctctaggaggacccaagctgacacaatgatgcccttcattgacttggagaaccttggaagaggcccaagttttggagggctccaattctgcacatgttggcttaggtgtcaggtgggcaaggaagctccatatctgctttcccactcagaagataatgcttgtgctttggtactaagctatcaaccatgtcctctgtgggagctagggtctggtcttgtttttaaaatgcttgttccatggataatcagcaattctcagtttagatctcaatactagaacta

SEQ ID NO: 1243 - DNA, 700 bp, Homo sapiens
ccaattctgcacatgttggcttaggtgtcaggtgggcaaggaagctccatatctgctttcccactcagaagataatgcttgtgctttggtactaagctatcaaccatgtcctctgtgggagctagggtctggtcttgtttttaaaatgcttgttccatggataatcagcaattctcagtttagatctcaatactagaactatttccctctagaaaagcacaacctaccaatagcaaaaaacatcccttaacttccttgaggaggagttaaaagtcaaaaaatcgaaaggagatgagcaattgttcctgaacagccaaagggaaataattttgatgtaggggggcccttagttttctgggaaaaggaagtctttttttttttttttttttttgagatggagttttgctcttgttccccaggctggaatgtgatggtgtggtcttggctcactacaatctctgcctcccaggttcaagtgattcttctacctcagcctcccaagtagctgggattacaggcacccgccaccacacctggctaatttttgtatttttagtagagacagggtttccttatgttggccaagctggtggcgaactccagacctcaggtgatccacccacctcagcctcccaaagtgctgggattacaggtgtgagtcactgcacccggcctggaagtcatcttttataagtgttcc

SEQ ID NO: 1244 - DNA, 700 bp, Homo sapiens
aagtagctgggattacaggcacccgccaccacacctggctaatttttgtatttttagtagagacagggtttccttatgttggccaagctggtggcgaactccagacctcaggtgatccacccacctcagcctcccaaagtgctgggattacaggtgtgagtcactgcacccggcctggaagtcatcttttataagtgttccttaaggaaagaacttacatgtttggcagcacagatggaaatctgtcattgttggtagaaagaagctagcactccaaaaggcacttttgctctgagcttagcctccctgagcaaggtgcccttggagagctgggtgtcaaaggatgaccctgtcactgaggttcagtcaccagcaacctgttgtgagtgaatcatctgtttgaaggcagagctcttcaggtccaccgctggttcttcccatggaaggaggcttgaacacaaatcatgagtactacatgaatatttgaacgtggcactcagtcatagtcaagtatagcatttccctcaccaactgcacaccccagggagcccatatccatctcatggtggtgtggaggctgacagtaggcgagtttacatgctttgttcccaagctgtcaggaagcccagatactattagtctgcttggtctaaaaagagaaagaagtaggtgtgggcttcatgaaggatgttttgctgag

SEQ ID NO: 1245 - DNA, 700 bp, Homo sapiens
gtcatagtcaagtatagcatttccctcaccaactgcacaccccagggagcccatatccatctcatggtggtgtggaggctgacagtaggcgagtttacatgctttgttcccaagctgtcaggaagcccagatactattagtctgcttggtctaaaaagagaaagaagtaggtgtgggcttcatgaaggatgttttgctgagggctgtgtctctcattcaaggatgaatgagtaaaagcatttgttaagttttttttttttaaaactaccaaatgtacagtgagtgtactacttaagcaccttagggataagcctgtcttttccgccaaaggtagttacaatttccctcatggaaccaagcataatatgataaggactaattatttgtagagtcaataattacattataatttacacgcatgatctaatttaatctttatagaaacctgatataggtaaggaattttacagttgaggaaacagtctcaggaaagttaagtgacttccccaaagttatagagctagtaagtgaagacatctacttttggaccatatactttatctactctggatctgggcacttagccaaagccatagtgcctccaagaaagaggatgtcatggggtaaaccttgaacatgaatagaattgggataatcagagatgaagcaggacaacgtatggatggaggcaggagtgtca

SEQ ID NO: 1246 - DNA, 700 bp, Homo sapiens
gacttccccaaagttatagagctagtaagtgaagacatctacttttggaccatatactttatctactctggatctgggcacttagccaaagccatagtgcctccaagaaagaggatgtcatggggtaaaccttgaacatgaatagaattgggataatcagagatgaagcaggacaacgtatggatggaggcaggagtgtcaaggagaaatagagagctaaaagtgtgtcatatcaggagttgaaatgcattaaaaatatgtgaagtttggacccttttatcgtaatataatgaccttctttgtcttgttaaaatctatttgtctgatattaatacagccattcaaactctcttttggttatttgtatggaagatctttccaaccttttaattttcaacctatttgtgtctttgaatctaaattgaaactgttgtagacatcataatagttgcatcatgattttaaaatctatttggtgaatctctgccttttaattgaagagttacatttaatataattactgaaaagggcttactcctgccattttgctatttgttttctatgtcttttatcttttttgctcctcaattccttcattactgctttcttttgtgttaaatccatattttctaggataattctaaatctgtatctttttaaagtatatattatttatttattttcttaataattgccctag

SEQ ID NO: 1247 - DNA, 700 bp, Homo sapiens
gagttacatttaatataattactgaaaagggcttactcctgccattttgctatttgttttctatgtcttttatcttttttgctcctcaattccttcattactgctttcttttgtgttaaatccatattttctaggataattctaaatctgtatctttttaaagtatatattatttatttattttcttaataattgccctagagattacagttcatatattaatttgtaacaacctggtttagattaataccaagttaatttcaataatatgcaaacactttgttcttattcagctctactccctttatattatatttccacaaattacatctttacacattgtatgcccatcaacctaaatttttaattattgctttatgcagttgtcttttaaaattatgtaggaaaagagaggttaggaaaaaaattaatactgccctttatatttacttaggtagctacctctccccatgttcattattccttcatgcagattcaagtattcaagttactggccagtgtcctttcattttagcctgaaagactccctttagcatttttttttttttttgagatggagtctccttgttctgttgtccaggctggagtgcagtggcacaatctcagctcactgcaacctctgcctcccaagttccagtgattctcgtgcctcagcctcccaagtagctgggattacaga

SEQ ID NO: 1248 - DNA, 700 bp, Homo sapiens
gtattcaagttactggccagtgtcctttcattttagcctgaaagactccctttagcatttttttttttttttgagatggagtctccttgttctgttgtccaggctggagtgcagtggcacaatctcagctcactgcaacctctgcctcccaagttccagtgattctcgtgcctcagcctcccaagtagctgggattacagacatgtgccaccagcctggctaatttttgtatttttagtagaggcagagtttcaccatattgaccaggctggtctcaaactccaaacctcaggtgatctgcccaccttggcctcccaaagtgctgggattacaggcatgagccactgtgcctggccctttagcatatttttttaagtactttaagttctagggtacatgtatacaatgtgcaggtttgttacataggtatacatgtgccatgttggtttgctgcacccatcaacttgtcatttacattagatatttctcctaatgctacccctccctcagcctcccaccccctgacaggccctggtgtgtaatgttccctgccctgtatccatgtgttctcattgttcaattcccacctatgagtgagaccatgtggtgtttggttttctgtcgttgtgagagtttgctgagaatgatggtttccagcctatccatgtccctgcaaaggacatgaactcatcctttttta

SEQ ID NO: 1249 - DNA, 700 bp, Homo sapiens
ccctccctcagcctcccaccccctgacaggccctggtgtgtaatgttccctgccctgtatccatgtgttctcattgttcaattcccacctatgagtgagaccatgtggtgtttggttttctgtcgttgtgagagtttgctgagaatgatggtttccagcctatccatgtccctgcaaaggacatgaactcatccttttttatggctgcatagtattccatggtgtatatgtgccacattttcttaatccagtctatcattgatgaacaactgggttgcttccaagtctttgctattgtgaatagtgccacaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactaatttacactcccaccaacagtgtaaaagctttcctatttctccacatcctctgcagcatctgttgtttcctgactttttaataatcgccattctaactggcgtgagatatctcattgtaattttgaattgcatttctctgatgagcagtgatgatgagcattttttcatgtgtctattggttgcataaatgtcttcttttgagaagtgtctgttcatatacttttcccctgtttgtttttt

SEQ ID NO: 1250 - DNA, 700 bp, Homo sapiens
tccacatcctctgcagcatctgttgtttcctgactttttaataatcgccattctaactggcgtgagatatctcattgtaattttgaattgcatttctctgatgagcagtgatgatgagcattttttcatgtgtctattggttgcataaatgtcttcttttgagaagtgtctgttcatatacttttcccctgtttgtttttttcttgtaaaattgtttaagttctttgtagattctagatattagccctttttcagatgggtagattgcaaaaattttctcctgttctgtaggttgcctgttcactctgatggtagtttcttttgctgtgcagaagctctttagtttaattagatcccatttgtcatttttggcttttgttgccattgcttttggtgttttattcatgaagtccttgcccatgcctgtgtcctgaatggtattgtctaggttttcttctaggtttttatggtgtttttttgtttgtttgtttttgttttttgagacagtctcactctgtcgcccaggctagagtgcagtggtgcaatctcggctcactgcaacctccgacttctgggttcacaccattctcctgcctcagcctcccgagtagctgggactacaggcacccaccactacgcctggctaattttttatatttttagtagagatggggtttcaccatcttagccaggatggtct

SEQ ID NO: 1251 - DNA, 700 bp, Homo sapiens
tgagacagtctcactctgtcgcccaggctagagtgcagtggtgcaatctcggctcactgcaacctccgacttctgggttcacaccattctcctgcctcagcctcccgagtagctgggactacaggcacccaccactacgcctggctaattttttatatttttagtagagatggggtttcaccatcttagccaggatggtctcgatctcctgacctcatgatccgccctcctcagcctcccaacgtgctgggattacaggcgtgagccactgcgcctggcaggttttcatcgttttagatcttaacgtctaagtctttaatccatcttgaattaatttttgtataaggtgtaaggaagggatccaatttcagctttctacatatggctagccagttttcccagcaccatttattaaatagggattcctttccccatttcttgttatttcttgtttttgtcaggtctgtcaaagatcaaatggttgtagatgtgtggtgttatttctgaggcctctgttctgttgcattggtctatatatctgttttcgtaccagtgccatgctgttttggttactgtagccttgtaatatagcttgaattcagacagcgtgatgcctccagctttgttctttttgcttaggattgtcttggctatgcgggctcttttttggttccatatgaactttaaagtagttttttcc

SEQ ID NO: 1252 - DNA, 700 bp, Homo sapiens
atttctgaggcctctgttctgttgcattggtctatatatctgttttcgtaccagtgccatgctgttttggttactgtagccttgtaatatagcttgaattcagacagcgtgatgcctccagctttgttctttttgcttaggattgtcttggctatgcgggctcttttttggttccatatgaactttaaagtagttttttccaattctgtgaagaaagtcattggtagcttgatggggatggcattgaatctgtacattaccttgggcagtatggccattttcacgatattgagtcttcctatccatgaacatggaatgttcttccatttgtttgtgtcctcttttatttcactgagcagtggtttgtagttctccttgaagaggtccttcacatcccttgtaagtcggattcctaggtattttgctctctttgtagcaattgtgaatgggagttcactcatgatttggctgtttatctgttattggggtataggaatgcttgtgaattttgcacattgattttctaacctgagactttgctgaagttgtttatcaacttaaggagattttgggctgagatgatggggttttctaaatatacaatcatgtcatctgcagacagggacaatttgacttcctcttttcctaattgaataccctttatttctttcccttgcctgattgctctgcccagaacttc

SEQ ID NO: 1253 - DNA, 700 bp, Homo sapiens
ttgtgaattttgcacattgattttctaacctgagactttgctgaagttgtttatcaacttaaggagattttgggctgagatgatggggttttctaaatatacaatcatgtcatctgcagacagggacaatttgacttcctcttttcctaattgaataccctttatttctttcccttgcctgattgctctgcccagaacttccaacaccatgttgaataggagtggtgagagagggcatccttgtcttgtgctggttttcaaagggaatgcttccagtttttgcccattcattatgatattggctgtgggtttgtcataaatagctcttattattttgagatacattccatcaatacctagtttattgagagtttttagcatgaagggctgttgaattttgtcaaaggccttttctgcatctattgagataatcatgtgttttttgtcattggttctgtttatatgatgcattacgtttatcgatttgtgtatgttgaaccagccttgcatcccagggatgaagccaacttgatcatggtggataagctttttgatgtgctgctggattcagtttgccagtattttattgaggatttttgcatcgatgttcatcagggatattgatataaaattctctttttttgttgtgtctctgccaggctttggtatcaggatgatgctggcctcataaaatgagtta

SEQ ID NO: 1254 - DNA, 700 bp, Homo sapiens
cagccttgcatcccagggatgaagccaacttgatcatggtggataagctttttgatgtgctgctggattcagtttgccagtattttattgaggatttttgcatcgatgttcatcagggatattgatataaaattctctttttttgttgtgtctctgccaggctttggtatcaggatgatgctggcctcataaaatgagttagggaggattccctctttttctattgattggcatagtttcagaagaaatggtagcagctcctctttgtacctctggtagaatttggctgtgaatctgtctggtcctggcctttttttggttgataggctattaattattgcctcaatttcagagcctgttattagtgtattcagagattcaactttttcctggtttagtctagggaaggtgtacgtgtccaggaatttatccatttcttctaaattttctagtttatttccgtagaggtgtttaaagtattctctgatggtagtttgtatttctgtgggattggtggtgatatcccctttatcattttttattgtgtctatttgattattctctctttttttctttattagtcttgctggcagtctatcaattttgttgatcatttcaaaaaactagctcctggattcattgattttttttgaagggttttttatgtctctatctccttcagttctgctctgatcttagt

SEQ ID NO: 1255 - DNA, 700 bp, Homo sapiens
tttctgtgggattggtggtgatatcccctttatcattttttattgtgtctatttgattattctctctttttttctttattagtcttgctggcagtctatcaattttgttgatcatttcaaaaaactagctcctggattcattgattttttttgaagggttttttatgtctctatctccttcagttctgctctgatcttagttatttcttgccttctgctagcttttgaatttgtttgctcttgcttctctagttcttttaattgtgatgttagggtgttgattttagatgtttcctgctttctcttgtgggcatttagtgcataaatttccctctacacactgttttaaatgtgtcccagggatgctggtgcgttgtatctttgttctcattgttttcaaagaacatctttatttctcccttcatttcgttattcatccagtagtcatttaggagcaggttgttcagtttccatgtagttgttcagttttgagtgagttccttaatcctgagttctaatttgattgcactgtggtctgagagacagtttgttgtgatttctgtacttttacatttgctgaggagtgctttgcttccaattacgtgttcaattttagaataagtgtgatgtggtgctgagcagaatgtatattctgttgatttggggtggagagttctgtagatgtctattaggtccactt

SEQ ID NO: 1256 - DNA, 700 bp, Homo sapiens
ccttaatcctgagttctaatttgattgcactgtggtctgagagacagtttgttgtgatttctgtacttttacatttgctgaggagtgctttgcttccaattacgtgttcaattttagaataagtgtgatgtggtgctgagcagaatgtatattctgttgatttggggtggagagttctgtagatgtctattaggtccacttggtgcagagctgagttctagtcctggatatccttgttgattttctgtctcattgatctgtctaatattgacagtggggtattaaagtcttccattattattgtgtgggagtctaagtctctttgtaggtctctaaggacttgttttatgaatctgggtgctcctatattggctgcatatatatttaggatagttagctcttcttgttgaattgatccctttaccattatgtaatggccttctttgtttcttttgatctttgttggtttaaagtctgtttttatcagaaactaggattgcaacccctgcttttgttttccatttgcttggtagatcttcctccatcccttcattttgagacaatatatatgtctttgctcatgagataggtcttctgaatacagcacactgatgggtcttgactctttatccaatttgccagtctgtgttttgtaattggggcatttagtccatttacatttaaggttaatattgttatg

SEQ ID NO: 1257 - DNA, 700 bp, Homo sapiens
caacccctgcttttgttttccatttgcttggtagatcttcctccatcccttcattttgagacaatatatatgtctttgctcatgagataggtcttctgaatacagcacactgatgggtcttgactctttatccaatttgccagtctgtgttttgtaattggggcatttagtccatttacatttaaggttaatattgttatgtgtgaatttgatcctgtcattatgatgttagctggttgttttgctcgttagttgatgcagtttcttcctagcattgatggtctttacaatttggcgtgtttttgcagtggttggtacaagttgttcctttccacgtttagtgcttccttcaggagctctttaaggcaggcctggtggtgacaaaatctctcagcatttgcttgtctggaaaggattttatttctccttcacttatgaagcttagtttggctggatatgaaattctgggttgaaaattcttttctttaagaatattgaatattgaatagtggcccccactctcttctggcttatagggtttctgcagagagatccactgttagtctgatgggcttccctttgtgggtaacccaacctttctctctggctgcccttaacattttttccttcatttcaaccttggtgaatctgacaattatgtgtcttggggttgctcttcttgaagagtatctttatggtg

SEQ ID NO: 1258 - DNA, 700 bp, Homo sapiens
tattgaatagtggcccccactctcttctggcttatagggtttctgcagagagatccactgttagtctgatgggcttccctttgtgggtaacccaacctttctctctggctgcccttaacattttttccttcatttcaaccttggtgaatctgacaattatgtgtcttggggttgctcttcttgaagagtatctttatggtgttctctgtatttcctgaacttgaatgttggcctgccttgctaggttggggaagttctcctggttaatatcttgaagagtgttttccaacttggttccattctccctgtcactttcaggtacaccaatcaaacctaggtctggtcttttcacatagtcccatatttcttggaggctttgttcgttccttttcattcttttttctctaatcttgtcttcacgctttatttctgatatcctttctcccgctagattgattcagctatggatacttgtgtatgcttcacaaagttcttgtgtgtgtttttcagctctatcaggtcgtttatgttcttctctaaactggttattctagttagtaattcctctaaccttttttcaaggttcttagcttccttgcactgggttagaacatgctcctttagctcagggggtttgttattacccaccttctgaaggctgtcatttcgtcaaactcattctccgtctagttttgttccc

SEQ ID NO: 1259 - DNA, 700 bp, Homo sapiens
gtgtttttcagctctatcaggtcgtttatgttcttctctaaactggttattctagttagtaattcctctaaccttttttcaaggttcttagcttccttgcactgggttagaacatgctcctttagctcagggggtttgttattacccaccttctgaaggctgtcatttcgtcaaactcattctccgtctagttttgttcccttgttggcgaggagttgtggtcctttggaggagaagaggcgttctggtttttggaattttcagcctttttgcactggtttttcctcatcttagtgcatttatctatctttggtctttgatgttggtgaccttcggatggggtttttgtgtggacgtccgttttcttgatgttgatgttgatgctgttcctgtttgctagttttccttctaatagtcagacccctctgctgcaggactgctagagtttgctggagatccactccagaccctgtttgcctgggtatcaccagcagaggctgcagaacagcaaaaatttctgcctgttcctacctctggaagcttcgtcccagaggggcaccccccagatgccagccagagctctcctgtatgaggtgtctgtcgacccctgttgggaggtgtctcccagttcggaggctcgggggtcagggacccacttgaggaggcagtctgtcccttagcagagctcaagtgctgtgct

SEQ ID NO: 1260 - DNA, 700 bp, Homo sapiens
gcagaacagcaaaaatttctgcctgttcctacctctggaagcttcgtcccagaggggcaccccccagatgccagccagagctctcctgtatgaggtgtctgtcgacccctgttgggaggtgtctcccagttcggaggctcgggggtcagggacccacttgaggaggcagtctgtcccttagcagagctcaagtgctgtgctgggagatccgctgctctcttcagcgccggcaggcacaacatttaagtctgctgaagctgcacccactgctgccccttcccccaggtgctctgtcccaaggagatgggaattttatctataagcccctgactagggctgctgcctttctttcagagatgccctgcgcagagaggaggaatctagagaggcagtctggctacagcggctttgccagactgcagtccctgggggctttgtttacactgtgaggggaaaactgcctactcaagcctcagtaatggtggacgcccctcccaccaccaagctcaagagtcccaggttgacttcagacagctgtgctggcagcaagaatttcaggccagtggatcttagcttgctgggctccatgggggtgggatccgctgagcaagaccacctggctccctggcttcagccccctttccgggggagtgaatggttctgtctcactggtgttccaggcatcactggggtatgaaaa

SEQ ID NO: 1261 - DNA, 700 bp, Homo sapiens
accaagctcaagagtcccaggttgacttcagacagctgtgctggcagcaagaatttcaggccagtggatcttagcttgctgggctccatgggggtgggatccgctgagcaagaccacctggctccctggcttcagccccctttccgggggagtgaatggttctgtctcactggtgttccaggcatcactggggtatgaaaaaaaactcctgcagctagcttggtgtctacccgaatggccgccctgttttgtgcttgaaacccagggtctggagatgtaggcacccaagggaatctcctggtctgcgggttgcgaagactgtggcaaaagcatagtatctgggccagagtgcactgtttctcatggcacagtccctcatggcttcccttggctaggggagggagttccctgtccccttgcacttcctgggtgaggcgatgccccaccctgctttggcttgccctccgtgggctgcacccactgtctaactagtcccaacgagatgagccgggtacctcagttggatatgcagaaatcacccaccttctgcgttgatctcgctaggagctccagaccagagctgttcctggggctttaacgtttttagtgctcatttgtttggcatggggtggggggcaattctatgaggacatttagaattttcagaactattttgctcataatcaggggttgcatgagc

SEQ ID NO: 1262 - DNA, 700 bp, Homo sapiens
gagatgagccgggtacctcagttggatatgcagaaatcacccaccttctgcgttgatctcgctaggagctccagaccagagctgttcctggggctttaacgtttttagtgctcatttgtttggcatggggtggggggcaattctatgaggacatttagaattttcagaactattttgctcataatcaggggttgcatgagcattaagtttcaaatctcttcagtagacgaaccatgcaaaataccaatatcactgtgtattagtatttagcagtcttatccttgatgtggagtgtatcctcacacttcctctatgagaagtcttttgtgagacttattcccaggtaaagagccagtcaggggcctggctgctgccctctggctggcgcaacagacagatgatgtcccagtgtctctggcggcttcttacagaactctgtccctgaggttatgtcccttcttcatgaggtgacaccttcaggggtgggtctgcctgagagctccaaaacatgatttctgctgagaaacctgtgtctgtcatcagtgcatcctctgttaatctcatgagattttattttccaaagtgcttttaaagcaatggcatagaacataaggtgttgccagtgcattgcatcaagcctctatcagcctaaaagccctttaggaaaagaattaaaagacaaacccccagaagaaagttc

SEQ ID NO: 1263 - DNA, 700 bp, Homo sapiens
ctccaaaacatgatttctgctgagaaacctgtgtctgtcatcagtgcatcctctgttaatctcatgagattttattttccaaagtgcttttaaagcaatggcatagaacataaggtgttgccagtgcattgcatcaagcctctatcagcctaaaagccctttaggaaaagaattaaaagacaaacccccagaagaaagttctattgtgctatttactacctggcagggaatagggtcttgtgcccacctcattgaccgtcacttagaccaggtattaagcagaataattctctttgacaaacaacagccttatggaatccatgagaatgttcagggaaccctgacagagataagaattagtttccaagaataggaaaagatggtatggcaaatctttgcctttactttgatctgtggcaggaaactggtttttaagaaaatctgggttgttcctccacctccttttctttgtcttttatatttctgtgggtatgctggtttctagttatacacattaactgaacacctcatcactcaccaactctgcccctgtggctacagtttgtgtatgcctctctcctggagcagaggagatccttggtctgataacacactcagtcttcccaaagtcatggctctaagggaaacaagccacacacgaatccaacaggcttcgacagaggacttggaattccacatg

SEQ ID NO: 1264 - DNA, 700 bp, Homo sapiens
ttctagttatacacattaactgaacacctcatcactcaccaactctgcccctgtggctacagtttgtgtatgcctctctcctggagcagaggagatccttggtctgataacacactcagtcttcccaaagtcatggctctaagggaaacaagccacacacgaatccaacaggcttcgacagaggacttggaattccacatgcttggctcaaccctggaagtgacttgggctcttgcctcaccacatgaagagctctaagcattcaggtaattatggtttttgccctcagaaggccacaaatgactggaatcagtggcatggagaataagagagaaaatgcagaaactattcactcctgctacaggacaatgggtagacagaactgcaattcagattctagagcccctgggaagacagttaatcagtagtccagcacagaaccatgtttgaggagagtggagaagccaacagtgttccagaagacgtgctgccttccttctcccccaagtttgatgctgcttgttttgttatgcaacatgcccttgagtttctatccaacactggagctttttacccaggtccatccacaccttctagcccaaaatgccctgtgcaaattgtatatagattaagacacctcttgtgcaccacactcaacccccaatcctctcagcccaccacttactccagccactgttgc

SEQ ID NO: 1265 - DNA, 700 bp, Homo sapiens
tcccccaagtttgatgctgcttgttttgttatgcaacatgcccttgagtttctatccaacactggagctttttacccaggtccatccacaccttctagcccaaaatgccctgtgcaaattgtatatagattaagacacctcttgtgcaccacactcaacccccaatcctctcagcccaccacttactccagccactgttgcagtgaccagttctgatgggctctggcaacccctacttcagccctgcaatgtattctctcttgctttctacccacgggacagaacttatttgggactcatgcatgtgcagcctggaaacatgtggagctgacacctgtgggctgcctttacaaatggatgccaacagagaaatgcttcccccttttactcaaggtacagatggtgttgagatgcatttcataagcttcttctgaagtccttgctggatggagcatccctgcctttggtgctagtcaacctgaaaatgcatctttgtattcagcctccctccttccctgttctcctcctgtcctttattgctgctccctggaatcttgtccccaaagcataaactgcttaactgcacagaagcacttgtctcagtctctactttcaagggaacccaagatacatttgtgcaagaaggctggctcagcccatagtcaattaataaagtgaagaattctagtgcacaagaatc

SEQ ID NO: 1266 - DNA, 700 bp, Homo sapiens
cagcctccctccttccctgttctcctcctgtcctttattgctgctccctggaatcttgtccccaaagcataaactgcttaactgcacagaagcacttgtctcagtctctactttcaagggaacccaagatacatttgtgcaagaaggctggctcagcccatagtcaattaataaagtgaagaattctagtgcacaagaatcaaatcttagtcttagagattaatcccaaccattgctagaattagcccaagctgatacagagaaaaggcagatgacagtgtggcacaggctcactaaattctagaaataaagattctaggcagttgctgatatttaaaaaatcattttacttattaaaactttctcatttcccaaggcacttcagtagctttcacaaaaacatgtttgttcttttttaaccaggtgaggcatatgctttaggagtaccatggtaacataatcagcaaagagaagacaattacactgaacacaaaatatcacccaataaagttacaggactaaagtgagctactctgaaagactatgaacacaatttaaatttcttttttgtaatatcctcccatgactaagtatcaagaaaggaacacacacaatgacactgtttttggcacttagagaagtgctagaggctagggctggtaaggccttgcaccagtggcagctgcagacaattgccaga

SEQ ID NO: 1267 - DNA, 700 bp, Homo sapiens
acccaataaagttacaggactaaagtgagctactctgaaagactatgaacacaatttaaatttcttttttgtaatatcctcccatgactaagtatcaagaaaggaacacacacaatgacactgtttttggcacttagagaagtgctagaggctagggctggtaaggccttgcaccagtggcagctgcagacaattgccagagtgattctgtgtttaaaaaaaaaaaaaaaaagacacaaaccaggaggctaaggaaccagcctttcccaagtgcattctgaagggcaaataacaaggagaaaaggatacaacaacaaacaaataaacagtaaaacaaaacccacattacagctttgagagaaaagacaacgttgctcatctctctcacctgataaatttcctttaaaccatacataagacgctatagtagcaaggaggtttccacagcagtggaaaacaagaatagtagattcaatggagcatttattatgagcctggacaagcccagtgctttgatcagatgtaaacaagtctactcagtcgtcatgctgagtggtcttaagagctcacacatcagtgcactttgctggtgatctgcatctgctcattctgctccatcttcattacctttcactttccctagctctgcgctctcctgccctggggaagcaatgatccagttaatgtcctctgtaactga

SEQ ID NO: 1268 - DNA, 700 bp, Homo sapiens
caagcccagtgctttgatcagatgtaaacaagtctactcagtcgtcatgctgagtggtcttaagagctcacacatcagtgcactttgctggtgatctgcatctgctcattctgctccatcttcattacctttcactttccctagctctgcgctctcctgccctggggaagcaatgatccagttaatgtcctctgtaactgagaaaaggtaagaatcaaactccttgtgcaattacttccttttcctctaaagttcaccactagaggggagtggggaaaggggtgggggacttagacctctagccttattaggggccttttcaagtagtctaaaattaaaatgtacatttagcatatgcttctcacattcctccagatctcactggttctagtgaaaaattaactgctttggaggtgctgagtccatcattgtaatagttaggacttagatgaagttgtctgtaggtagccccagtgtccctagaggaaggtggtgctctagggccatatgtagcctctgagtgtgggtgcccatccaggagcaagtcagacacaggtcaagaggacaaacagcaaaggcctttgtcactgaaggactcggagtctgcacaagctggccatttctggcaagacagtctttcctcttcagtttctcccttactggaagcgatgttagaaggctgtgcttttaaggattgtgg

SEQ ID NO: 1269 - DNA, 700 bp, Homo sapiens
agggccatatgtagcctctgagtgtgggtgcccatccaggagcaagtcagacacaggtcaagaggacaaacagcaaaggcctttgtcactgaaggactcggagtctgcacaagctggccatttctggcaagacagtctttcctcttcagtttctcccttactggaagcgatgttagaaggctgtgcttttaaggattgtgggcctttcttgaccatcttttaacatccttgtgtgacttggagtttttctgtgtttcattctataaaaacaagcaaaaatatgtcagtaacacattttaaaaagatgcctcccagtctccaaacaaacaagaactgaggatatcttccctgggaagagaatcctgcagcagattctgaaaggtttcttctagcctctgagttatccagtgcggctactgccatggagatgtgtatagtgacatgtccacacaggaacagaccagagaggatgggctataagtaagcaccttgccatttacaaccctttaatggctaaactagtccatggtgtctgtgagagggagtttgcgagtagctctattgtgaggggctcctgagacctggccagacccagacccagtgcatcaacactgacagaggaggtcttcttaccctttgactcttagcatctggtcaatggtgtctgggagtggggtaccgaagctctctgggagaaaca

SEQ ID NO: 1270 - DNA, 700 bp, Homo sapiens
caaccctttaatggctaaactagtccatggtgtctgtgagagggagtttgcgagtagctctattgtgaggggctcctgagacctggccagacccagacccagtgcatcaacactgacagaggaggtcttcttaccctttgactcttagcatctggtcaatggtgtctgggagtggggtaccgaagctctctgggagaaacaaggtgaggatggctgtcaggatggtcagacttcccatgagaatgtagggcaggaagcggtcgtaggcacctatggcaaagcagacggagcctcaggcccagggctgcagttagacttggtctctcatctacccctttatgctcccaggactctggaaggggatcactttccttcttggtctcacatctctcacagtctgagcagtcagattagaatctggcatctagacaggtttcagaacccagagctggcacaggcatgcccagagcccagcagtgttccaccatgcaggggaggagtacaaaggggcggttgcaggagaagagctgggccatgctgattattcctatttctgggccatgctgattattcttatttaccaaggttgggtttccaaggaacctgaggtacttgtccagggatggaaataactcttccacctctgcagatgtgtcccagcccatgtgatctgccttcagattaggcagggtgcttttgc

SEQ ID NO: 1271 - DNA, 700 bp, Homo sapiens
gtacaaaggggcggttgcaggagaagagctgggccatgctgattattcctatttctgggccatgctgattattcttatttaccaaggttgggtttccaaggaacctgaggtacttgtccagggatggaaataactcttccacctctgcagatgtgtcccagcccatgtgatctgccttcagattaggcagggtgcttttgcttgctttgagatctacatagcatgttcacaaagcactctgagtactctcaggtgggtgccaccctccctaaagaggtactggctagggatgtgcagggaaaccacaggtgctatgaagacataattctgagaagagaaaactggagacctgctacataaaatggcatggggtggatcttcacacaagataaaatcactctatagtgctctaggttataataattttacgttcatcagacctcttgcatggacatctttcccctcatgttccttttaaactctgattccaagaaatttctccaactaagcacactggctccctaaaccactctgtaggttcttaggataaaggaattgtagtctctgatggaaggcctgggatggctaaaacagaaacaaaccctctaatattctcatcaatttctaggtaatctataggttgttttccatttgaaagtgagggccagtgcactgggacaagaacccttcccggccaaag

SEQ ID NO: 1272 - DNA, 700 bp, Homo sapiens
tccaactaagcacactggctccctaaaccactctgtaggttcttaggataaaggaattgtagtctctgatggaaggcctgggatggctaaaacagaaacaaaccctctaatattctcatcaatttctaggtaatctataggttgttttccatttgaaagtgagggccagtgcactgggacaagaacccttcccggccaaagatccagtactggatggagcccatgtactgtatgaacttgttttcctgttaacacgcaacctccagctcacattcaagccagttagtacttccatcccgttgctctagtgtgcccttggctcatgggacttaccaaggtaaacgaagtagggagacaggatgctgcccaggcgggatgctgtggagctgactcccacacccatgtttctcaccactgtgggatacagctcggctgtgtacacgtagaccatggaaaaggcagccgtgactccaaacttgcccaccatcaccaggactgtagccaaataatacaagtctggagaagcaaaggaaagagggtaggagtaggtaccaacccatggcatgcagctattgagagcaaaacaaacatactttcttcccaaattttttggggagtcagtttctatcacttcctattgtgggggaaggggctatagccaagatttccctccaaattgattgctgaaaggaggctggga

SEQ ID NO: 1273 - DNA, 700 bp, Homo sapiens
agccaaataatacaagtctggagaagcaaaggaaagagggtaggagtaggtaccaacccatggcatgcagctattgagagcaaaacaaacatactttcttcccaaattttttggggagtcagtttctatcacttcctattgtgggggaaggggctatagccaagatttccctccaaattgattgctgaaaggaggctgggacctgcagctataaggacatgcactttcctcaacctggagaccaccagagtaagctccttaatagtccaatcaacctgcttcccagtctataagtcattaaagacatgtctgtcagggattaactgtcaccccagaacctcacactgcaggcactatggaattaactcatgatgtttagatgaatggagaattcagttctaactcatttcatgctttcctcccactcagacctcaaaaaaatcataggccatcagaatctcgagttgatcttctaatctctctgtgctgtgctgatgggagagctatgtgtgacctgaaggtcactctgagctcagctgtgagcctctacatcagttctgggctcctcctgccacatcccatggggagctgttcccgtgcagtgttctcagcctgatgggcccaaaagtgaccatcagaggctcccaaatctacaggtacactgaagtctctgggcacagtgatggagagggagagatga

SEQ ID NO: 1274 - DNA, 700 bp, Homo sapiens
agagctatgtgtgacctgaaggtcactctgagctcagctgtgagcctctacatcagttctgggctcctcctgccacatcccatggggagctgttcccgtgcagtgttctcagcctgatgggcccaaaagtgaccatcagaggctcccaaatctacaggtacactgaagtctctgggcacagtgatggagagggagagatgagggcccatgaactgttctataaattattggaaatggctacctcccacccatctgtgggatactaagatagtttcagaaataaaatcctgctaagggtctgtgaggccctctcagtggtctggcccctccccttctccctcctcctcaaacatgccaggctcatcccctgctcagggtcgctgcctttgccatttcttcttcctaaaatgttctcctagactttttcagggctttctgtcactttatgtacatttctactgaactgccccctgttcagggacactatctgtgactatgtaaactaactcggcattgtccttcatttgtattcctagaaggtaacacagtctgaactatattaagcattttatttacttgtttgttgtctgtcttctcatctagggtgtacgttccatgagggcctggggttctgcctggcttgttttcttgtgtatcgttatcaccgagcacagtgcccagcccatggtaggcatgccat

SEQ ID NO: 1275 - DNA, 700 bp, Homo sapiens
aaactaactcggcattgtccttcatttgtattcctagaaggtaacacagtctgaactatattaagcattttatttacttgtttgttgtctgtcttctcatctagggtgtacgttccatgagggcctggggttctgcctggcttgttttcttgtgtatcgttatcaccgagcacagtgcccagcccatggtaggcatgccatagctatttgttgaataaataaagaagacagggccaggaaaaaaaggaatgggatagctatttcttccctcttcttctgcagtggaaaacagtatgagcacattaacttgggtacagagtaaaattaaccaacagccccaatggctgctttttcccactccctcaaagcccaggccataagtgttctagtctcagaagacactttctattgatttttaggccaagaatgtatataagcaagggagctgtgatgggcttgattttattctctttattaattgagacagcctggtagacagtaagagactcagtgaagaccccaaaccatagatgcacatggtccctacctgggggtaccagctgcatgaagagaaggacactgccacccaggaagagggcagtggccatggaatagcgccggggcaaatattgcagcagcagccaggccaacacatatgctgggacttcaaccatcgctgaaaggaagcagttcacaaaga

SEQ ID NO: 1276 - DNA, 700 bp, Homo sapiens
taagagactcagtgaagaccccaaaccatagatgcacatggtccctacctgggggtaccagctgcatgaagagaaggacactgccacccaggaagagggcagtggccatggaatagcgccggggcaaatattgcagcagcagccaggccaacacatatgctgggacttcaaccatcgctgaaaggaagcagttcacaaagatgtccccatgcaagttaggagtatcaagcgaaagcccaaaatagcccactgatatggtcatcctgaaacagagtgcagaagaaagctggaaaagcagtatccacatctttcccaacctgtacaacttttacaatgcaattatttcagtaaattccaaaccatctttaagcagagactagtaaggcagcagtaactgtaaccctgcgtcttacttcatagatcaaaagataattttccccagcccaagtggtacagtgtaaaccctgcgccagtgcgctctcagagccttccatatagacagtgtcccagcaaaaaagcttgtataattcagatagatttacttcattgaaaagaaaaattccaacctgcctttcagctttaaaaatcctaagctgaacctcctcaaatccagcaactgcagaaggagctagagaatgagtcaggaggcagacatcaagtgaggtgtgataggatttgggggataagataacaaaaggaa

SEQ ID NO: 1277 - DNA, 700 bp, Homo sapiens
cagtgtcccagcaaaaaagcttgtataattcagatagatttacttcattgaaaagaaaaattccaacctgcctttcagctttaaaaatcctaagctgaacctcctcaaatccagcaactgcagaaggagctagagaatgagtcaggaggcagacatcaagtgaggtgtgataggatttgggggataagataacaaaaggaacaacattaggtcaaacacttggagagagaccctcacacactacctgtggtgaccagtcaggaagaggctggtcagagacagctgacaccagccccgcggtacttgtggagcagagaggtggctcccaatggaggggccacactgcctctcatcaggatgccctgcagtacccctgacctgggcatccccagtaggcattctctctgttgatgacccacactctttgacaaaccagacctttatggattagactgttttgactcatctgcaggtggaacacacagctggtacaataaaaagagtatgtgcatgagtccccaggaaatccagagcagggaggagagcctgggtgaacacaaaagtgggtgactcatcacaggcttgcatgtctgtggtgcaggctacatgctgctcctgtcttgaggccaactcagggaatggtgaactgcctggagggatcctgggccattccttggaagcgggtgactcatagcactcc

SEQ ID NO: 1278 - DNA, 700 bp, Homo sapiens
agagtatgtgcatgagtccccaggaaatccagagcagggaggagagcctgggtgaacacaaaagtgggtgactcatcacaggcttgcatgtctgtggtgcaggctacatgctgctcctgtcttgaggccaactcagggaatggtgaactgcctggagggatcctgggccattccttggaagcgggtgactcatagcactccctcagtaggcacagtggctgactgcctcaaagctggatgagactagtaataaggactctgagatgaagtccgccctcctcgcccatcttctcaccgctaacccaccaggctccagaagtcgcctagaatcccagggttcggccgctgagcaaaagctagcgatgtgcacttggacatgtttcctctccctggtaattcacaaatccctttctgacatactttgcctcattagtgggaacctggtaaggacatctaggctatagccctgactccaggaccgtttatggacatcccaggaggagcacatcccacttccacatttccagaaagtaactggcagcctctgcagcctacaggacatggtgtcttcactcagatccttcttaaaagccctacctggcctcctcagccactgtcggtaactgggtaggagacgggaactaaatgacccaaattgggcaaggattcatcttaagatctggagagattccccacgaga

SEQ ID NO: 1279 - DNA, 700 bp, Homo sapiens
ggagcacatcccacttccacatttccagaaagtaactggcagcctctgcagcctacaggacatggtgtcttcactcagatccttcttaaaagccctacctggcctcctcagccactgtcggtaactgggtaggagacgggaactaaatgacccaaattgggcaaggattcatcttaagatctggagagattccccacgagagtccatatttcccacaacagcctccacaattgttttcattctccttttctgaggttccatcccattaagaattgtgacatgcccattttttccatctaacacaagacatatccttttcactctctgatgacataggctttgaattttgtctgaggcatgtctgtaaacaagaggcccaatggccacttcaagaagctttgtctggaagcctcaggcaggtctcttttacataccacagcattatggacatgatggtgaccatccggatattccaggttcgaagcagatccagaatgttgtgggactgctgcttcttggaacttaggtcttgtaactgcaggaacaacatcataagtgtatgggaagaagaggtggtcagagactcagagcacacaataacatacttgaatccctggcatcttagctgtctgcatctcagcgtcggggagtgttacgtttctaagaacagtaagtatactgactgtgttttaggctgtga

SEQ ID NO: 1280 - DNA, 700 bp, Homo sapiens
gtgggactgctgcttcttggaacttaggtcttgtaactgcaggaacaacatcataagtgtatgggaagaagaggtggtcagagactcagagcacacaataacatacttgaatccctggcatcttagctgtctgcatctcagcgtcggggagtgttacgtttctaagaacagtaagtatactgactgtgttttaggctgtgaaaacttccctaggccttgtcagtaacaaatcagagtgaatgaaaatgaggaaaagtaagtgaccagtccctcaagggtacaggaagacagaggcccaggctgacagcttcctcactgcacccccacatattcctgtcggtggccacattccaaggaggcctctaagtattcctcccgaagcctggctccctgccctctgggtcagagagagtacctggctgtgtggtttattggtctgatattttttaaaagttaatgttttgagtccttatactatgtagttactggtgtgcttccagggaaaaagaattcaaatagaaaaacaggaaaattgacctgagcttcacccagagtgacttcctatgaaattcagcacagccaaggccattaataaaccacacgtctaaacacactgatgttgctttcttaagcaaacccaggtttggagcttgtttttccagagttagaagttcaacaaaaggtcaactttggactgaaa

SEQ ID NO: 1281 - DNA, 700 bp, Homo sapiens
gggaaaaagaattcaaatagaaaaacaggaaaattgacctgagcttcacccagagtgacttcctatgaaattcagcacagccaaggccattaataaaccacacgtctaaacacactgatgttgctttcttaagcaaacccaggtttggagcttgtttttccagagttagaagttcaacaaaaggtcaactttggactgaaagtatcccctgaaatagcctcatttcctcaaagatgccagtggggcttatgcattcacccagattgacccctcacttaaaagcccccaaaaccacctaacttaaaagccctctgccacactcctgcctgacctttgcgcacaggacccctttctggtgcatgctgacagtggctgctgggccaccactcactgggaagtctgcagggctggcagtggccattggcctccgctgtctacaataactgttccctcttttccaagcccaaccatgcctgcctctcacacttcagcagggctgcttgtggctgttcccacacccaacccctcatcttccagtcagaccacagacacattccagaaccccaccaggcagcatttacagcttctaacctctcatagtcacgagaccaaggaaaactgcctgctacagagatggtaggagagggaacgggaaggaaaagcaagaaccaggaactaggtagagccaagaaatgagtca

SEQ ID NO: 1282 - DNA, 700 bp, Homo sapiens
cttgtggctgttcccacacccaacccctcatcttccagtcagaccacagacacattccagaaccccaccaggcagcatttacagcttctaacctctcatagtcacgagaccaaggaaaactgcctgctacagagatggtaggagagggaacgggaaggaaaagcaagaaccaggaactaggtagagccaagaaatgagtcatggtgtgtgagaacagggctgacgggaggggtggggtagggggaagaggtggacatcaaaaaggacctgactccaagatgatatgcaataattaaccattggagggcagaaagagactaaacactttttttttctttttaatgaataattgctaatactcaagagatgaaatacttctaactccaaatctatttgtgctttacattttacgtttggggttagctttgtaaggtgacaagccaccttaggtataagaaacaatgattttcccaaatgctgactttatgaaaggcctattactcaaaaagagtatttattgttagaagtaatggttaaaatatatgattgcctagaaaggaagtaaaaaatgaaaatctgaaacccgtggtgaaaagagtgaggcagctgtaacctattcctcaacttctgagtgttaacagggcccgtgtgggggtggggagtggggggatggggggaatgggcagttggggcttgggca

SEQ ID NO: 1283 - DNA, 700 bp, Homo sapiens
actcaaaaagagtatttattgttagaagtaatggttaaaatatatgattgcctagaaaggaagtaaaaaatgaaaatctgaaacccgtggtgaaaagagtgaggcagctgtaacctattcctcaacttctgagtgttaacagggcccgtgtgggggtggggagtggggggatggggggaatgggcagttggggcttgggcagagagagggctgggctgctgtgagcagggaggacttcagggctgggtgctgctgctctcaaatcacggtcagtctgtccctctcacccacacccacatggtgcttacctcactcgggtcaaagatagtggaaggcacaacaatcccattggctttggcagccttgcggatgatcacctctgcctcttcaaatcgtccctgagagatgagccatcggggggactcagggatgaacctggcagtacaaggtccaatctcagtgaggcctccctgccaacagcagacccacagaccaggtagagcacagccataggtgggaataaggttgcagaaccagagcttgtggaatgtttggtgatcacaagccagaagcaaagagctgatccacacgcagcaataacctggggtggatgagcttatgtgtaccccacaccgcacaaaaatgggagagccctgcaccccctgacggcatccccatgctggctggccacctccatttc

SEQ ID NO: 1284 - DNA, 700 bp, Homo sapiens
gagcacagccataggtgggaataaggttgcagaaccagagcttgtggaatgtttggtgatcacaagccagaagcaaagagctgatccacacgcagcaataacctggggtggatgagcttatgtgtaccccacaccgcacaaaaatgggagagccctgcaccccctgacggcatccccatgctggctggccacctccatttctgaagagcagtgttgccatctgctgggctgaggagatgggtgcaagatgggctccggaagcctggcttctgtgcatgtctatgtcagcccaggccctgctacactctcctccctgtccccggcaccaacagaagcttctgcactggccttttagcttctcttctctcctcaccctacccctgatttatccaacagattagtcagatactctacctaaaatagcatgtttggccaggtgcagtggttcactcctataatcccagcactttaggaggccaaggccggtggatcatttgaggctaggagttccagaccagcctggccaacgcagtgaaacccgtctctccaaagaaatacaaaaaaaattagccaagtgcggtggcaggcacctgtagtcccagctactcgggaggctgagacatgagaatcgcttgaactggggaggcggaggttgcagtaagtggaaatcacgccactgcactacagcctgggcaacaga

SEQ ID NO: 1285 - DNA, 700 bp, Homo sapiens
gctaggagttccagaccagcctggccaacgcagtgaaacccgtctctccaaagaaatacaaaaaaaattagccaagtgcggtggcaggcacctgtagtcccagctactcgggaggctgagacatgagaatcgcttgaactggggaggcggaggttgcagtaagtggaaatcacgccactgcactacagcctgggcaacagagactttgtctgagaaaaaaaaaagaaaaaaaaagaaaaagaaaagaaaaaaaggaaaaaaattagcatgtttatcaaggcacttgagtgctctatggatattattttccaccttgctgggaccaggtagccgccccccaccctcggtcatgactgggccccatgatgtgcggcttactctcccactatgccctgaaatgctctctgctccacttgggctggtgatctcaccttctccacctgcaaggggtgattcccaccttagcacctctgcagtgttcccctcttggtctggaatggcctcttctctgcctgttcaactcctctaccttggtggtgcagaaggagcctggcttcctccatgtggctaccctgaggactcttgcttttggtgccagtgcctgtggcatgaggcttcagcagcacacagccagaactagggcctacactgtcctgccctgaggcttgggaacttcctacagggcatgctggaccccatc

SEQ ID NO: 1286 - DNA, 700 bp, Homo sapiens
gcctcttctctgcctgttcaactcctctaccttggtggtgcagaaggagcctggcttcctccatgtggctaccctgaggactcttgcttttggtgccagtgcctgtggcatgaggcttcagcagcacacagccagaactagggcctacactgtcctgccctgaggcttgggaacttcctacagggcatgctggaccccatcttctcacagctactgctatttttccccacacttggggcaacccagcacagggctgagagcaagtctgttgctgtcatgggattctgttttgttttggctcttttgagtgtggagaaaacattctgaaataatttataatctatgcttcctgtctctgggagacaaaatagggattcatgggttgttgctgccctctagtgaaggccagacagaaatcatcctgccagtgggcacatggggcacagggtcacactcaccaccagagtgccacgcacagcacccccggcatcgtcagcgccaccagcagcatccgccagtctcggatgaagtaagcaaacagtggcagcaccatgtagccaaatgcataaaatatgcacactcctaacgtagagaatattatacgaactgacttgccaagaatttctgtccctgttcaaaacaagggaggtcgagttagcagtttaatttgggttccttccttattaattttttatggtat

SEQ ID NO: 1287 - DNA, 700 bp, Homo sapiens
caccagcagcatccgccagtctcggatgaagtaagcaaacagtggcagcaccatgtagccaaatgcataaaatatgcacactcctaacgtagagaatattatacgaactgacttgccaagaatttctgtccctgttcaaaacaagggaggtcgagttagcagtttaatttgggttccttccttattaattttttatggtatctttgtgaatacacagacaagaaaacagcgagaactctctctaagttcatggcgctagggagcggatggcgttctgaacccctcctgtctgactgtctcctgggggtacatccctgtggcctctcaggcccccaagcaacagttctctcttgaaaatttcgccatgttctgaagccatgtgctaaagatgccatggtaggccccctttaatcctcacatgaggaagaatttattaaaagtgaagtcattactaagtcagcacatgctgacttaagcctcaaggaaagaatattaaatataaaaagaaaaaacaaccctttcaacaatacaacccaaggaactcaaaggccttatcagctagagtcaggttcctccaaacacaggccggcctggcagcttctcagtgacaacaggctggcacatttgagacaaagccctgcagtgtgcactctgaattaaaaccctgaaggtgacgaaagccccttcctatcaatttatt

SEQ ID NO: 1288 - DNA, 700 bp, Homo sapiens
taaaaagaaaaaacaaccctttcaacaatacaacccaaggaactcaaaggccttatcagctagagtcaggttcctccaaacacaggccggcctggcagcttctcagtgacaacaggctggcacatttgagacaaagccctgcagtgtgcactctgaattaaaaccctgaaggtgacgaaagccccttcctatcaatttattcttgtccgtagatatcaccagccacagtgctctgcagacaaggggttctctaccttagcaagcttgccagtcacagcccctcctcctccaaccatgccgccctctttctggggctggctcagccctgtgcagtggcaggccctttttgtaaatggaggatctctggtgagtcctagtaaattgactaccaagtactaagaccaaggagccacagcccagaggccagaaaagaactggaaatcagaagtcaggccattgtgctgctggggaccccaggctggtctcatgtctggctcagtttccctgcctgtaagtaaggttcaccaggaagctctggctagttttgttagaaaccctgtcccccttgagggacatcacagctgtctccagaaaggtaggtgatgggatgatggtgaaatacaggatcaagtactcaactccaacctgatggccatacccaggacaaatgctgccacatagttggagatctggcccatgc

SEQ ID NO: 1289 - DNA, 700 bp, Homo sapiens
tttccctgcctgtaagtaaggttcaccaggaagctctggctagttttgttagaaaccctgtcccccttgagggacatcacagctgtctccagaaaggtaggtgatgggatgatggtgaaatacaggatcaagtactcaactccaacctgatggccatacccaggacaaatgctgccacatagttggagatctggcccatgcctacaaggacaaacagcacgacaaacatctcaaaattcttcgagaagatctgcaggaagctgaagcctgtctgcatgcccatggtcacgaacagcacattcttccggccaaacctgggaagaaaaggagagtgacagataaccagctggaaaagggcagcaggaatgggctccaccaagtggggctttctcaagatccatccagtaagtgggtgtgaacagtgttgccagaatactggctgccagggacagtctcggtctcacagtgcccatgctatttctccccctccccactccccatgacaaatgtacagcctgggtaccagggttgcctaaaaagcaatgctacaattatgataatgattgcaagagactgaaatacatcaattatttaatccatacattcataatgatattttttttaaaaaagaatctgccaaatttggagaataacagagaaacaattcattataaatgaaaactggcaaataaagagaaag

SEQ ID NO: 1290 - DNA, 700 bp, Homo sapiens
atgacaaatgtacagcctgggtaccagggttgcctaaaaagcaatgctacaattatgataatgattgcaagagactgaaatacatcaattatttaatccatacattcataatgatattttttttaaaaaagaatctgccaaatttggagaataacagagaaacaattcattataaatgaaaactggcaaataaagagaaagaagcatttgtcctgattttcctttgtaaactatgtgaacagcaaccaataatagataagaggtagtatcatgtacaaaagtattctaacttttaaatgaaaaggtaataaaattagaataataccatttatagcccccaatggattaatagatctatgcattatatactaattactgttaacatcataaagagacagtcaggaattgcatgcttcctatggtcttgccaaaaggactgaacctgaatcagaacctgaatctcaagtctctggatccaactgccaattttgaggaaatgcagagcatagaggaatgtgctgaactgcatcatcagtgtgcaatcaacaaatccagactgggaaattctataggtggaatagctcaggttcttcatagataatcagtaaggcatagaaggcgatagaaggagaatccatagattaagtagactaaaagacatcaaatatattaagtgggcaacactaaatttgtgtcaagg

SEQ ID NO: 1291 - DNA, 700 bp, Homo sapiens
cagagcatagaggaatgtgctgaactgcatcatcagtgtgcaatcaacaaatccagactgggaaattctataggtggaatagctcaggttcttcatagataatcagtaaggcatagaaggcgatagaaggagaatccatagattaagtagactaaaagacatcaaatatattaagtgggcaacactaaatttgtgtcaaggatgcatatttcgataataaaactaaaaaaactcacaaggaagtgattattacaggagtcaggctagcggttacttaatggggagagagagaggatgctgtaattgggatggggcacatggacagggcttcttagtggacagcaaagttctactgctcgacttggtggtggtcataaggttatttctctgaaaaaaattcattaagctacacatttgttctgtgtggttttctgtatccgtgctcattttaaaaagtttttaaaattgggtttattttggtttgttttaaagagagtgccacaaacaggaggaaaaagtcaagctagtgggaagcagtgggttcagtttgagtctggccagtactggctgacacccactttcattcaatgtttattgagcatctattatagagggcacttggatatcaataaattaaaaaagatgctgtttctgcccttaaggagtgtcatagtataactggtgaaacacatattaacca

SEQ ID NO: 1292 - DNA, 700 bp, Homo sapiens
cacaaacaggaggaaaaagtcaagctagtgggaagcagtgggttcagtttgagtctggccagtactggctgacacccactttcattcaatgtttattgagcatctattatagagggcacttggatatcaataaattaaaaaagatgctgtttctgcccttaaggagtgtcatagtataactggtgaaacacatattaaccacattttaatctaacaacacgctactgaatatacaattacacactgagtcaagtgcactgaaggatcggcatgcaggttaatgagaggcacaaggaaggaagctaccctggactgggggtaagggttggggaactggacattcagggagggtctccttgatcatgggacactgagatgggaaaaaatagttgacgatgggggatttaaggtgtagggaccaagctctcaatgatattcacagtatagtggggaagaccaacattaatcctataataacactttttttcccccaatttctggtagacgttttaaaggaaagtcataaggaactagggatcctgaattagccagcatggttaaagaaggccacagggggtgggttggggtgggtggggaatgcttcagactctgagaagaccacacacccccatggctggagggggcatggtgaacatgaggaaccagtgtggttggcatcaggcgtgcaattcaagagtac

SEQ ID NO: 1293 - DNA, 700 bp, Homo sapiens
ggtagacgttttaaaggaaagtcataaggaactagggatcctgaattagccagcatggttaaagaaggccacagggggtgggttggggtgggtggggaatgcttcagactctgagaagaccacacacccccatggctggagggggcatggtgaacatgaggaaccagtgtggttggcatcaggcgtgcaattcaagagtacagtggtggctaggaggcaaattgcacaaggtcttgcaactatgtggaagagtttggtgtttttcctcaataaaagaggtttttttctgttgttgttttttttttccatcacttggggttcactggcatctaatgagtagaggccagatatgttgttaaatattctaaaatgcccaggaaaatgccctagaacaaaattatttggctcaaaatgttaatagggtcgaggttgagaaactctcgcctggtagtagactctactttcccctgcatggtttttttaacaagcatgttctatatgccaaccaaggggtggttcctaaccacaaggcaggctggtataatctctatgccctttcccttcctaagagctccctgggatggtagggaagagacagatccagagaaccctttacatagcaccagtccttggcagttcagggttggggccagaaatgtttgcttttaaagtctgtcaacaaaatggcaaacacacacat

SEQ ID NO: 1294 - DNA, 700 bp, Homo sapiens
tgccaaccaaggggtggttcctaaccacaaggcaggctggtataatctctatgccctttcccttcctaagagctccctgggatggtagggaagagacagatccagagaaccctttacatagcaccagtccttggcagttcagggttggggccagaaatgtttgcttttaaagtctgtcaacaaaatggcaaacacacacatacctggaaacaggacacagcagtctacttcttcctagagttgtgcatctcttacaagtcagacgcataaagataactcaatagtgttacataaagggctttgacaacccaggagtactttaattgctcttgaatttcagacatattcataggccagaaagaaggtgaaacctttatactatataaaaagttacattgatgtcctagacaagttagggcatgaattgattgctttcaggtaatctacttagcttaggttttagaactggtttactcagaagtaatgcactcagaagctgtccatcccacagggccctgggccttccaagggggcacagacaggcttgaggcagggcattgggaattgaaggcaggggctgcaggcagaacagccatacttttagccacttagggtgtatttcatttactagacttaaattatcctactttaatgaaagttctgtggccaaaatgtttagaaaggtttgaaaaacactata

SEQ ID NO: 1295 - DNA, 700 bp, Homo sapiens
tccatcccacagggccctgggccttccaagggggcacagacaggcttgaggcagggcattgggaattgaaggcaggggctgcaggcagaacagccatacttttagccacttagggtgtatttcatttactagacttaaattatcctactttaatgaaagttctgtggccaaaatgtttagaaaggtttgaaaaacactatattagcccttctgtagactaaagtggtcctaaacacactcacaaattttgtttccactttccctgggaatagaccttttggaacttaaatgctttcctcaggtaatcattgtgtcacatggcaagaaggttcttaagctgacccatgacacagctgacccagaaaaatacactgcatttctactctgaacttggggtatctccttttcacatcaagggcattcttctgagccgcagctgtcacttagctccgtgagaaggaatctcccatgtccactcaggtggcctctaagcatagcacaatcctcccccagttcccccctcccctccccactcccctctccccaggcaacctcatccctatctggggctctgctgagggttctatatgctgacaaatcctacatgtgtttctctagccaaaacctctcatgcagtaccatatccatacagccagcttcacactctacttctccacttaggggtctcatagtcacccca

SEQ ID NO: 1296 - DNA, 700 bp, Homo sapiens
caatcctcccccagttcccccctcccctccccactcccctctccccaggcaacctcatccctatctggggctctgctgagggttctatatgctgacaaatcctacatgtgtttctctagccaaaacctctcatgcagtaccatatccatacagccagcttcacactctacttctccacttaggggtctcatagtcaccccaaatttagtacacacaaattgaactcaatatccatgaacgtggttcttttccagcattctctgtcttagagaagtgtaccttcattcacccagttactcaggccagaaagctttcttcccccaattccgacatccagcccatcggcaagtcttgttgattttacctcttaccacttccctccatttctaccaccgtcatgctaggccatgccaccatcatctctggcatgaactactgtgacaaccttttaattggtctctctacaacaccttttgcttcccttcaattctttcttcacaaggttgtcaaagcatctttaaaaaaaaaaaaaggacaaatctgattgtcacactattgctttaaaaaatctcagtagcccaccgctgctctgtggctgaagcccaaagtcctaactgtgatccactaagccctggttgctcatctgcccagggctctgcctgcctctccccttcatcttaacaccactctccgcacctct

SEQ ID NO: 1297 - DNA, 700 bp, Homo sapiens
aaggttgtcaaagcatctttaaaaaaaaaaaaaggacaaatctgattgtcacactattgctttaaaaaatctcagtagcccaccgctgctctgtggctgaagcccaaagtcctaactgtgatccactaagccctggttgctcatctgcccagggctctgcctgcctctccccttcatcttaacaccactctccgcacctctaccacacggactttgtcctgctcccatgccttttcatgagccccggctttagcacttgctattctccctgcctggatgttctttctcctctctacccctcagctggctactttcgactcatcttcccactctcgctcatgcttcaccttctcagggatgctgcccctgacctcctctgttagacactcctgtggcaccctgcacttctctgtatctcttaccatggccaaggacaacaacgacttcctcacttggttgtttaatacattccaccttgctagaaagcaagttttaggacagcagggacctagaacagtagtccatacacaatagaggagcaagactacctgggtccaaatcctaactctgccacttgccagctgtgaaaccttggggaagttatttaatccctctgtctcactttctccatctgtaaagtaggaataataaacaggttaacctgctttttaaaaaaaaatctggctgggcaggtgcagtg

SEQ ID NO: 1298 - DNA, 700 bp, Homo sapiens
agcagggacctagaacagtagtccatacacaatagaggagcaagactacctgggtccaaatcctaactctgccacttgccagctgtgaaaccttggggaagttatttaatccctctgtctcactttctccatctgtaaagtaggaataataaacaggttaacctgctttttaaaaaaaaatctggctgggcaggtgcagtggctcgcgcctgtaatcccagcactttgggaggccgaggtgggtggatcacctgaggtcgggagtttgagaccagcctgaccaacatggagaaaccttgtctctattaaaaatacaaaattagctgggcatggtggtgcatgcctgtaatcccagcaactcaggaggctgagacaggagaatctcttgaacctgggaggcagaggttgcagtgagccgagatcgtgccattgcactccagcctgggtaacaagagtgaaactccttttccaaaaaaaaacaacaacaataaaaaatatctggctgcgcatggtgtctcacgcctgtaatcccagcactttgggaggttatggagggaggattgcttgaggccaggaattaaaaaccagggaagatgctgggactcctttccaccggctaacccaccgatttgtggggtgttctcacatgtgccatgtggccaaggacttgctgaaggctgctactctcttcacagtcttc

SEQ ID NO: 1299 - DNA, 700 bp, Homo sapiens
tggctgcgcatggtgtctcacgcctgtaatcccagcactttgggaggttatggagggaggattgcttgaggccaggaattaaaaaccagggaagatgctgggactcctttccaccggctaacccaccgatttgtggggtgttctcacatgtgccatgtggccaaggacttgctgaaggctgctactctcttcacagtcttctctgacagaccctgaagctccagggaaagaagacacaacataatggacccctctaagaacttcatgaaagctacggacctctctccaaaaaaatgctcacatgtagtctctaacattgtgcatataatttcgaggggtttgggattctctaagccgttaatgtttccttgagttaaaagctttagaattatacaaataacctgcttataagaaatggatcaaaacactattctccctcctgtcataaagtaaatgccaaaaccacaggccacttagctaaggggcatcagccttgtggacaaaagagttctgcttttcataccactagtggctggtgagagctcctttcactttgcagagagaatgctggtcttcttgggactacagaggcagacaccgtggcactactacagatctacaatctagcacatgtgcatgtgtgcatgatgtcaacctctcccatgctcaggggcatgacagagtcacagtgacccagggg

SEQ ID NO: 1300 - DNA, 700 bp, Homo sapiens
acaaaagagttctgcttttcataccactagtggctggtgagagctcctttcactttgcagagagaatgctggtcttcttgggactacagaggcagacaccgtggcactactacagatctacaatctagcacatgtgcatgtgtgcatgatgtcaacctctcccatgctcaggggcatgacagagtcacagtgacccaggggaggcaagccaggctactgcagaagtgaatcatggcatattacctagtcaaccggatcacagatacattcagcttagacagctcaggtttctttacttagcaagaattacggagtcagatgatttgttggctcttcttactaggcatggagtctatatcacagacatagcttcctcttctttaaaatacagggccctgcgctgaaagaatactaccaactgaaatcaagggccaggcacacgcttcttcctcagtgctgaggtcccctggtgctccagaagacagacaccttacctgtctgacagctgccctgaaatgaaggagcccaacagcacacccacgaagaacaaggagattgtgagtggggccttccagtcgtcctcacacaccaggttccactgcaagatgagcaaagggggtgtatcattcacttctttttaaaaggttttaaagcaaaggcatcctggaaaatgaagtcagaacatcctgccatccccaca

SEQ ID NO: 1301 - DNA, 700 bp, Homo sapiens
tgacagctgccctgaaatgaaggagcccaacagcacacccacgaagaacaaggagattgtgagtggggccttccagtcgtcctcacacaccaggttccactgcaagatgagcaaagggggtgtatcattcacttctttttaaaaggttttaaagcaaaggcatcctggaaaatgaagtcagaacatcctgccatccccacacgctctgagtgtgaactcacttagtcaggtgatggctcacctgggcaggaaggcagagagcaggcttctttcccatcctgtttttcatagcattgtaggccccactgtcttgcttccattttgaggaggagagacaggcagagagtaagtgttctgtccacatgctgaccctggagaaagcaaggcctctaacgcttgctcctaaaaatctgagcggagcccagggctgtggaagaggcagggcaccctcgctcagtggggttcaggccattggcatgaacgtcactggagtggttctggaagcagggctctggggctctacgggccaaagcatccagcaagaaactaaggccagggcacagagtgcaccatctggacctgctctgctcaggttcccaccctgggccaatgacccccgggtcctttttgtgacctttagagctggaatccctgatgctgcacaccaactatactaggctcaattacagctgaaagccct

SEQ ID NO: 1302 - DNA, 700 bp, Homo sapiens
ggaagcagggctctggggctctacgggccaaagcatccagcaagaaactaaggccagggcacagagtgcaccatctggacctgctctgctcaggttcccaccctgggccaatgacccccgggtcctttttgtgacctttagagctggaatccctgatgctgcacaccaactatactaggctcaattacagctgaaagccctgagcttggaggtaagaaactgggttttagctcccactctactattaactcttccaacctcagataagcatcaccccatgctgtgccttgatttccccatttgtaaaacagggattggggtaaggaataggctgcaccgcttgagtttccagcttccaatgtgtggttccatctatagttaccatgaacagaaaaagaggtctgaagacatggggaagcagccagacgcttggatctggctacgcctgcctaaacaagagccaaaagcaggaagaaagcccaaacgggaaacttagtggttcacagaaaaatgaaaaatgtttttcagacagagagatggtgctcagtagtaacctttgcagacttctcacatgagcaaccaccctcctaggaactcagacccttgcctccctggtgccaggctgctagcctgccctccacggagcctgctggctcctcaccaacaacgcaggcaaggggacatgcggctccctagaaca

SEQ ID NO: 1303 - DNA, 700 bp, Homo sapiens
ttcacagaaaaatgaaaaatgtttttcagacagagagatggtgctcagtagtaacctttgcagacttctcacatgagcaaccaccctcctaggaactcagacccttgcctccctggtgccaggctgctagcctgccctccacggagcctgctggctcctcaccaacaacgcaggcaaggggacatgcggctccctagaacaaagcatctcttccaagccagtgacagggaaaaacaagcctgcttctccgcactgctgggcagtgtgggcgcacagcctccgggcacctctcagaggggttggcaggcaaccctcaggctggacacggagaactcccgcagcaggcacactgctggtgctccgctttggaataagcgtgaacctggatgggctgggagtagggtggcaatccccaacccagggaagaactggagcatccaacccctaatcaggaggcagcccagactagcaggagtcaagaacatgggaggaccacagcctgactgcccaggctgccacagcctccaacctccacagcctcagaagggccagcacccacaggccatctctctggtaggtgggtaagtatccctgcagtggcccccacccacacatggctgctaaatctaggactgggagtggaggcggagaaaaagctgagggaattgatgacagggtgccggcctctgtgtgtgaggcc

SEQ ID NO: 1304 - DNA, 700 bp, Homo sapiens
ctgactgcccaggctgccacagcctccaacctccacagcctcagaagggccagcacccacaggccatctctctggtaggtgggtaagtatccctgcagtggcccccacccacacatggctgctaaatctaggactgggagtggaggcggagaaaaagctgagggaattgatgacagggtgccggcctctgtgtgtgaggccaagcttcaggggccaggacctggctcctgccactcttgagtatgatgggctctatttcccagctagcatgtcttttatagtggaaaagatgaaaacatgaacaaagggtcagcagcggtttctcacaggactatcatgaggtgagggttggggacccatatggctgagctagactagcaatccacgtgggcttctgcagtgagttctggggttgtagaccccaggacaggtctcccaatatcaggcttctaaagactccttggctggcaaggttgggtgtgacctaaaaccaggtcagacaatctctgcaggggacagggtgactatagtgctcattttgagacaggccccagagcatctctcaggctcccttagccccaccctctctacttggtccagcctgtccttagtctaggcaggtgtgtaactccttggttaactctgccatccacccaccactgaccgcccttgacaactctctgggcctggctttgggccc

SEQ ID NO: 1305 - DNA, 700 bp, Homo sapiens
acaatctctgcaggggacagggtgactatagtgctcattttgagacaggccccagagcatctctcaggctcccttagccccaccctctctacttggtccagcctgtccttagtctaggcaggtgtgtaactccttggttaactctgccatccacccaccactgaccgcccttgacaactctctgggcctggctttgggccctccaaaagcaaatatgcattaacacttctttcctattggccgcagggggtctgtgagcaggatcaggaaaggtgctaggtctcaaaactgaacacaagggcaaacatagattgggtcccagcctgccaatccgtccacatatctgtcaaccaccagatggactgcagtaggttccaggacttggccagaatctccctgagaagaggtggatgagaagcacatagagtccaggctaagtaccccctacttaaattgtttacaaaggagtctagcattccttagctcctggctccccagctgtgattaaagctgctacagaccagcttattgatgcctccgcctggcacatgggatgggctatactggctgatgatcacaggtatcaatgttaaaatggaatgtgtgggtttaagatttgggtcacgagtctaatgctgtcacccttcagctggctgagctgtgaatgcaggcccaacctgaaaacaatctgggagcaact

SEQ ID NO: 1306 - DNA, 700 bp, Homo sapiens
tgtgattaaagctgctacagaccagcttattgatgcctccgcctggcacatgggatgggctatactggctgatgatcacaggtatcaatgttaaaatggaatgtgtgggtttaagatttgggtcacgagtctaatgctgtcacccttcagctggctgagctgtgaatgcaggcccaacctgaaaacaatctgggagcaactctggcaaagggcctagacttgcccctcttcctggggagaaatgcacctttctagtggtgatggtttcaagggtgtagagatacatgtgtgccaaattgcatgctttagctacatgcagtttttatgtcatttacaccttaataaagctattaaacatttttaaaaagagggagaattgtgtctcctatacctcatacataattggcactgctttttcagttatgagaagtagagagatgacatagttccctgggactaaatgttcttacctgtgaattggcaggaagggaaaaaagatagggtgtgtgcccctaagacagaagttcttccctgaggggatgtacctagcctgaccgtatcaacagtcagacatgctgctaggtaccacatgttactgattgccatgtattcctatattcctacacacattttatcctgcctcctgctgaaatcaatgatgaatccttgccccaccgttgtcagagcaaagagaaaaggt

SEQ ID NO: 1307 - DNA, 700 bp, Homo sapiens
agggtgtgtgcccctaagacagaagttcttccctgaggggatgtacctagcctgaccgtatcaacagtcagacatgctgctaggtaccacatgttactgattgccatgtattcctatattcctacacacattttatcctgcctcctgctgaaatcaatgatgaatccttgccccaccgttgtcagagcaaagagaaaaggtatttcctatctttgctatcacatcctctacaactcctggcagtgccccctgtatcgaagagaggctcaggagctctttggtacataggtgagtgaatgaatcgataaataaaaaggtatcaaccttcaacatcttggtatactttagttcttgcttggctgcccaaagtcgagatgaaccctgaactcctgaacttcaatctccagaatactcttttttttcttttgaaacagagtcttgctctgtctcccaggctggagtgcagtggcacaatctcggctcactgcaacctccacctcccgggttcaagtgattctcatgcctcagcctcctgagtggctgggactacagggatgcaccaccagcctggctaatttttgtatttttagtagagacggggttttgccatgttgaccaggctggtcttgaactctgacctcaggttatctgcccaccttggcctcccaaagccctgggattacaggcaagagccaccaca

SEQ ID NO: 1308 - DNA, 700 bp, Homo sapiens
cccgggttcaagtgattctcatgcctcagcctcctgagtggctgggactacagggatgcaccaccagcctggctaatttttgtatttttagtagagacggggttttgccatgttgaccaggctggtcttgaactctgacctcaggttatctgcccaccttggcctcccaaagccctgggattacaggcaagagccaccacacctggccatttttttttttggctccctgaccccctgctttgtgtcaactgtcagaaatttgacccaggatgacaggtgtcagctagctagagagtggctcaatctgaccactcatggccagatgtgtctactatgtacgtgcatagtgggccacgggaccccgcaagtggcttctctgccttgccatatagctgcaaaaggctggatgagggtctgtgtgtcccctgagtgagagaaatcaacaaaggcgtaacagtgaggttcaagttccaggtctctcgggtctctgctgcccagagtcagccccggtcccagctcccaggttgctctggcttttcctccaggcagctttggggataacagtgagggctctctcatcttctaagactatctgtctctacacaagataaggctgatagaaaagctagtccaggacaatggggagggagtgggagtcccacccaggactgggccgagggcttcttagaagcagacaggt

SEQ ID NO: 1309 - DNA, 700 bp, Homo sapiens
gtcagccccggtcccagctcccaggttgctctggcttttcctccaggcagctttggggataacagtgagggctctctcatcttctaagactatctgtctctacacaagataaggctgatagaaaagctagtccaggacaatggggagggagtgggagtcccacccaggactgggccgagggcttcttagaagcagacaggtggagagcaaggcgatgcagagcagcttggaagtttcttttctttttctttttttttttttgagacggagtcttgctcttgtcacccaggctggcatgcaatggtgcgatcttggctactgcaacccccacttcccaggttcaagaaattctcctgcctcagcctccctcccgagtagctgggattacaggcacccgccaccacgcagggctaatttttgtatttttagcggagacgaggtttcaccatgttggccaggctggtctcgaactcctgccttgtgatccacctgcctcagcctcccaaagtgctgggtttacaggcatgagccaccacacccagccggaagtttctcaaggaacctgtctgtccataggctggacagagctatggtgaaaccaaagagcggacagcccagacaacctcagaaacaacccaggtttccagcagatggggcagtccatggccaagaagcactgcatgatgggttggctaattcc

SEQ ID NO: 1310 - DNA, 700 bp, Homo sapiens
ctcccaaagtgctgggtttacaggcatgagccaccacacccagccggaagtttctcaaggaacctgtctgtccataggctggacagagctatggtgaaaccaaagagcggacagcccagacaacctcagaaacaacccaggtttccagcagatggggcagtccatggccaagaagcactgcatgatgggttggctaattccccagtaccccagggatgactgaggggccagaggagaggccagccgagaaccatgtggaccaccaaactattcctggaacatgggggcataaaactcttttacctcataaatcatttttatttattaatattattattattcttttgagatggagtctcgctttgtcgcccaggctagagtgcagaggctcgatctcggttcactgcaaagcccgcctcctgggttcaagcgattctcctgcttcagtctcccaagtagctgggaatacaggcatgtgccaccacacccagctaatttttgtatttttagtagagatggagtttcaccatgttggccagactggtcttgaactcccgacctcaagtgacctgctgccttggcttcccaaagtgctgggattacaggcgtgagccaccacgccctgccaatatttatttatttattaattgctagcagattccctctgccaatcccaacacctcattccacatccatgtgg

SEQ ID NO: 1311 - DNA, 700 bp, Homo sapiens
tgtatttttagtagagatggagtttcaccatgttggccagactggtcttgaactcccgacctcaagtgacctgctgccttggcttcccaaagtgctgggattacaggcgtgagccaccacgccctgccaatatttatttatttattaattgctagcagattccctctgccaatcccaacacctcattccacatccatgtggcatcaaagccccagtcagtgggcagggggagtcacatttcctttaaaaaattccagtcaatccttttcagccaccctcaagtttcccttctaagaactgaactatttttctttagttctcaaactttagagatgatttcttaaattattcattaactcattcaataaaaattttcctgagaacctccctctgcatccagaattgtgtcagaaattgaggaagacgcaaagatctaaatccaccacaaagtttggtactacatgtatgtactttaacttgaacaaattaaaaaaatccaaacaggacacctgaggttccagtcttcagtggaaaaaatatgactagtaattcaataccagtgtacttacaaacacctttatgtatgatttggggcagagggcaggcttagagacatttagcaggcatgggactagatgcagtgttcagcaggccaggtttgggttgaaagacaacaggccatagaaaaagccattagaat

SEQ ID NO: 1312 - DNA, 700 bp, Homo sapiens
aacaggacacctgaggttccagtcttcagtggaaaaaatatgactagtaattcaataccagtgtacttacaaacacctttatgtatgatttggggcagagggcaggcttagagacatttagcaggcatgggactagatgcagtgttcagcaggccaggtttgggttgaaagacaacaggccatagaaaaagccattagaatgttgatgcagcaacttccagcagtagctgttcacctgggaacaagcagctctgaacttcaagtcaagcattccagtagcccaaaacaaagatctaagcattaatctggcctccctgcaaagactgacaacatataagtaggtgaaagggcacataactcctttgaaactgctaagacagctaaataaatagtctaaatattaaaaaacaaaaggctgacattggcagcaagataaggtcagaccccctggcacagctggcctttgggagctcatcaatgccaccatcactcagcccaatgtgggatggaggcagcaaagcaggaacaagtgactagagtaagccggggaaccctcaggggtcaatgtaaaactccaagagatgccatgtgcttcttcttgcttcactacttccctcttctttaggcagccccaagtagaatttgtagggattcctgtgtcatgttcccctctgtggcctctgcctgcaacctcagggac

SEQ ID NO: 1313 - DNA, 700 bp, Homo sapiens
tgtgggatggaggcagcaaagcaggaacaagtgactagagtaagccggggaaccctcaggggtcaatgtaaaactccaagagatgccatgtgcttcttcttgcttcactacttccctcttctttaggcagccccaagtagaatttgtagggattcctgtgtcatgttcccctctgtggcctctgcctgcaacctcagggacagcctctgctttcatagtactcactggcttccgggaaggtaacacacccacctgtgaggctaggacccaggatttgtggcaactgaaagttccaatttcctgtggattcatgggccagaaagcacagttggctacctccaaggagtgcctcttttgtcaagccatgatgcctctggacactgaagctatgtcactagctaagaaatcccagtggggctccggtcacactcccactacatatatgtggagaaagcaggtccaaatgctggggacatcaaatttccaaaaagaaaaaacacacacatgcacacacacttggatctcccagggtagctctcagactccattgaagggtgatgacgccaagaagcaacacagttgggatctccagagcccctgtaagcccctctgaggctccaggaggggaggctcagcaccaacatccagcagggcttgaagctgtgccagggcctgtggcactctccctctctatgaactc

SEQ ID NO: 1314 - DNA, 700 bp, Homo sapiens
cacacatgcacacacacttggatctcccagggtagctctcagactccattgaagggtgatgacgccaagaagcaacacagttgggatctccagagcccctgtaagcccctctgaggctccaggaggggaggctcagcaccaacatccagcagggcttgaagctgtgccagggcctgtggcactctccctctctatgaactctcccctctctgtgaactccgccgtcctgctgggtggtttcttgctgctgcattggggccttcagctcactattatgctgagctgaacaccctaggctcactgagaggcctcctcttctgggaagccttctctaacctgcgaattggtcatctgcacatttagtgagcctatctatcaatgagggctactcactggctacttactcaatgctgctgaaacttcagggagctagagtgccagtgtctaaaaaagacacaaaacacatacatcattaacatcatgttcctacatccagctccaacaactgctccaacaggttcggaggggacagacaaaaccacccagagggaaaatccaaggggatgagaaatgagaaaggctcccccacaccctatgacctaaggctgtatgctttaactaaatctggccgacagccttgcctcataatacctgagaaaatattccaggtcaacaagtcaccctgaacccatcttcagat

SEQ ID NO: 1315 - DNA, 700 bp, Homo sapiens
caacaactgctccaacaggttcggaggggacagacaaaaccacccagagggaaaatccaaggggatgagaaatgagaaaggctcccccacaccctatgacctaaggctgtatgctttaactaaatctggccgacagccttgcctcataatacctgagaaaatattccaggtcaacaagtcaccctgaacccatcttcagatgaatggatcttaaagagtgacaactgacggcctggcgtggtggctcacggttgtaatcccagctttgcaggcagaagcaggcagatcacgaggtcaagagatcgagaccatcctggccaacacggtgaaaccccgtctctactaaaaacacaaaaattagctgggcgtcgtggctcacagctactcggaggctgaggcaggagaatcacttgagcccggaaggcgaagattgcagtgagccaagaacgcacgactgcgaaggttgcagtgagccaagaacacacgactgcgctccagcctggtgacagagggagactctgtctcaaaaaaaaaaaaaaaaaaaaaagactgacaactgaccatgggaaaaggcaaacaattacttacagggcatgaccagattgtcgtttttgggttgtggacggtaggggaaggagtaactagaggaaaaagggaagaggcagttgtatacacatgctttatttaacttttaaaagtt

SEQ ID NO: 1316 - DNA, 700 bp, Homo sapiens
ctggtgacagagggagactctgtctcaaaaaaaaaaaaaaaaaaaaaagactgacaactgaccatgggaaaaggcaaacaattacttacagggcatgaccagattgtcgtttttgggttgtggacggtaggggaaggagtaactagaggaaaaagggaagaggcagttgtatacacatgctttatttaacttttaaaagttcaggaaagagaagtatttcttctcttctaaaaagaaatcaagagactagaggaaaaacgggatagcccctggcccaagtcctggctctgctacttaccacccccaaccccaactagagtaagtcctggacacacagggccatagagcatcgcccagggaccgccaggaccttcctggtaccctcttcaaagtggccatcaggacgggaggccagactgaccacctgtgcagggaggagcacactgtggctggaggtcacctcgtgaagcgttcccaagccacctggctggagggtctccatcgctagggtgttgaccgttgggggagggggagtgacagcgtccagtgcgcatctgggagagaggagctcgggttcaaggaccgcgacaggtcctccgagccctggtctcagccccagcaggggccggcacccacctcggtcacaatggtggacaggtagacgtcctgactgaactcccagccatccagacagctctcc

SEQ ID NO: 1317 - DNA, 700 bp, Homo sapiens
catcgctagggtgttgaccgttgggggagggggagtgacagcgtccagtgcgcatctgggagagaggagctcgggttcaaggaccgcgacaggtcctccgagccctggtctcagccccagcaggggccggcacccacctcggtcacaatggtggacaggtagacgtcctgactgaactcccagccatccagacagctctcctgctccagctgccccaggtccacgtcgcgccccggctccagcccgagcgccgagaagttggcgatggtggcgagccggtagcggcggcagctgtggggcacctcgcggccgtcccgcagccgcagtgggacagtgtggttgcgccaggcgctgctcaggttcgcggcgtccggcacccggcagcggtgctccggggtcgctatcaggaacacggaggacaggccggtgaagccattggggatgatgctggcgctgagcaggaagaagatgaggcgctggaagggcccccactcgcccaggaaggcggtcacctcgtcgtagtcccgcatgccgccctcagaggcccacagagcgcggcctggggtctgggaacgcggcgggctttgcgcgtgcgcgcggggcacccgccgccgaccaggcaagccaggcagcaggcgacccaagaccgtccgcggagggtaggctcgcgagctgacaccgccgccttggtcctgccgcg

SEQ ID NO: 1318 - DNA, 700 bp, Homo sapiens
ggaaggcggtcacctcgtcgtagtcccgcatgccgccctcagaggcccacagagcgcggcctggggtctgggaacgcggcgggctttgcgcgtgcgcgcggggcacccgccgccgaccaggcaagccaggcagcaggcgacccaagaccgtccgcggagggtaggctcgcgagctgacaccgccgccttggtcctgccgcggctggccttacatatggcgcacgaccagggaaggttccgggcctgggccgcaaggcgcgccccgctggcaggcagagcggcgccggcgaaggcggagctggggcgggacgcgagggcgcggggcgggccgggagtgcacctgaggcccgggcggggcctgtcctggggacctggcgaggcccggcctctgccagccacgcctgctggggacgaccgaggtagcccggggtcggcttaggaaggcagcgggactcgaggccttggggtccgagtccgaactcgctcctctagcgccgggcggggagcgagtgggagagcggccgcgaagctccagtgttgaaaacgcacccctcccagctttttgcaaggcctacttgggggcggaggtaaggagaaagtcactggcccagggtctcacagatagttgctcttgacaccgcctaatcttataagagggacggggattattttgaacctgggactgttaactaccctagta

SEQ ID NO: 1319 - DNA, 700 bp, Homo sapiens
cggggagcgagtgggagagcggccgcgaagctccagtgttgaaaacgcacccctcccagctttttgcaaggcctacttgggggcggaggtaaggagaaagtcactggcccagggtctcacagatagttgctcttgacaccgcctaatcttataagagggacggggattattttgaacctgggactgttaactaccctagtagagaggctgggagctatgacttttcattctagtccagatgccctttccacattttcgtctgtaacaagccattttgttcatgcagatgtaaaaatttaacttcacgattaacgatcctagcctagggttaaatattccccacagattagttatttccgtgcagagtttattcagaagctaactggaaaaaaaaaaaaagcagcgaggtgattctaaagcagcaatgttccataggataaggagctacatttgttatgttaacttttctagtagccatattaataaaattgccagatttagcaaataaaaatataggactcctagttaaatttgaatttcagatatagaatgaataatttttaaatattatgtcccaagcaggaatatataaaataaaaatgtaactggttgtcctgtattttattgggcaatgctgcatatttaaaaagtaaaaataaaagatgaaattaactttagtggtatatttaatcaagtatat

SEQ ID NO: 1320 - DNA, 700 bp, Homo sapiens
agcaaataaaaatataggactcctagttaaatttgaatttcagatatagaatgaataatttttaaatattatgtcccaagcaggaatatataaaataaaaatgtaactggttgtcctgtattttattgggcaatgctgcatatttaaaaagtaaaaataaaagatgaaattaactttagtggtatatttaatcaagtatatccagaacatgatcatttcatcatataatcaatatagaaattattgatattttacattgttatatgtaaatcattgatctttttttcccctcctcatactaaatcttaagaattcagtgtgtttcacaggttctcaggatttgaaaaaaaaaaaaaaaggaatccagtgtgtattttacagcacatttcaatttggactagccacactttttattttttaatatttatttattcatttatttattggagacacggtcccactgtgtcacccaggctagagtgcagtggcacaatcatagctcaccgcagccctgaactcctaagcttaagtgggcctcctgcctcagcctgctgagtagctaggactacaggcacatgccaccgtgcccagctaatttttttattttttttattttacagagacaaggcatccctgtgttgcccaggctggtctcagactcctgggtttaagcaatcctcccacctcagcctcccaaaat

SEQ ID NO: 1321 - DNA, 700 bp, Homo sapiens
ctcaccgcagccctgaactcctaagcttaagtgggcctcctgcctcagcctgctgagtagctaggactacaggcacatgccaccgtgcccagctaatttttttattttttttattttacagagacaaggcatccctgtgttgcccaggctggtctcagactcctgggtttaagcaatcctcccacctcagcctcccaaaatgctgaattacagacgtgagccactatgcctggccagactcattttttaagtgctcagtagccacatgtagctattggttatcttattggacagcaccattcctaaggcctttaagaatttgggctgctaaacttaacaatgcaagatattcctttttaaaatagtagtggcttagtgatagaaacagaactaagtgtatatttttacaatataatgtgttgggtaaagaatatttaatagtcactatattatgagttgaaaataaagctacagaaagggaacctaacctggccagcagatttttaataaggaaatctaaacatttgcataaagcataatagacttaaaaaaattatgataaagatgttatcacaggacttgtttgtttctttatacttactattcactattcttacttcgtgaagatggatggttataccttcagcaatgtacttaaatccttctaacatcttatgtgaagttatagttcttatctaga

SEQ ID NO: 1322 - DNA, 700 bp, Homo sapiens
atttttaataaggaaatctaaacatttgcataaagcataatagacttaaaaaaattatgataaagatgttatcacaggacttgtttgtttctttatacttactattcactattcttacttcgtgaagatggatggttataccttcagcaatgtacttaaatccttctaacatcttatgtgaagttatagttcttatctagaactaactgaaaaagaaagcaaagcttcttgaaaataaactccttttttgtgtgctaaaatattattttaatgcttcaaaagaaatgaaagcttttatgagaagaatgttgacctctgtccagaccaaacaagatgaagaagtcttattttaacatttgagaaatatcagttgggcatcagataacattcctgaaagggactgaaaacaatgcagtatactacaaaagaagctgcatatccttaggaagaaaagaaactatttgtcatagatggcttgtccacatgcgcaaagcagagagcaacctaagatggtgccgtccagttccaggtgcactgtgattactatctgaatgccattactatttaaattgcattttttttttgagacagggtctccttctgtcacccaggctggagtgcagtgaggtggtcttggctcactgcagcctcaacctcctgggctcaagcaatcctcccacctgagccttccaagtgcctg

SEQ ID NO: 1323 - DNA, 700 bp, Homo sapiens
gcaacctaagatggtgccgtccagttccaggtgcactgtgattactatctgaatgccattactatttaaattgcattttttttttgagacagggtctccttctgtcacccaggctggagtgcagtgaggtggtcttggctcactgcagcctcaacctcctgggctcaagcaatcctcccacctgagccttccaagtgcctgggactacagccacgcgccgctacacccagctattttttttgtatttttggtagagacagggttttgccattttggccaagctggtctcaaattcctgacctcaagtgatccccccgtcttggcctcccaaagtactgggattataggtaggagccaccatacccagccttaaatttcatcttttaaaagagaaagagagcttagaatcttaatcagttacctgaggccctttatcctgcaatattctgaattgggatgttcctattttacatattaaaaaatgtaaaactgatttatatggtagataaccctacagttcagggctagaactttagattaaatgcattcataccctggcagatgtggtagcttgcctccaagatggcacccaatgaatgatccctgtaccaggattggtctatgtgaccaaaagcatacagcattagtgatgatacttatatcacttgggtaattacattataaaagatgtccatcatgg

SEQ ID NO: 1324 - DNA, 700 bp, Homo sapiens
tggtagataaccctacagttcagggctagaactttagattaaatgcattcataccctggcagatgtggtagcttgcctccaagatggcacccaatgaatgatccctgtaccaggattggtctatgtgaccaaaagcatacagcattagtgatgatacttatatcacttgggtaattacattataaaagatgtccatcatgggtgttcttttccctttctcttgctcagagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcagttaagtggctcccagattcctgatcctcagaaactctgagaaataatgaatgttggttgttttaaaatggtaaattttgaggtattatgttatgtggcaatagatagctaatatataaattatttgaatcaaacaatacgttaaattaaagctcagaagaataaacatctgtaattccttaatttgttttcccttctattctacagaatagaattttacagatgaaccttgtagttacttgtgcaataagagacagt

SEQ ID NO: 1325 - DNA, 700 bp, Homo sapiens
ttgttttaaaatggtaaattttgaggtattatgttatgtggcaatagatagctaatatataaattatttgaatcaaacaatacgttaaattaaagctcagaagaataaacatctgtaattccttaatttgttttcccttctattctacagaatagaattttacagatgaaccttgtagttacttgtgcaataagagacagtatgttgtattgattaagtgcagagcctctggatgtatgatagaagaaagaccaatattcaattgctttcttcttcaattccaagcttgtgagcttgagcaaattttaaaagtgttttaagcctcagtttcctgggatggtagtgcttagctcgagctcctagcatatattaactacaaactaaatattagctataattattagttttactttgattattgactctaaataaataccttaagaactttgtgttctccacagatttggatatgtctggacgttatgtaggctggagtagtcagcaattacttgcctgaggaagggaaggcctcctcctttaagaaaagaataggctgggtgcggtggctcatacttgtaatcccagcattttgggaggctgaggagggtggatcacctgaggtcaggagtttgagaccagcctaaggaacatggtgaaaccctgtctctactaaaaatacaaaaattagccaattgtggca

SEQ ID NO: 1326 - DNA, 700 bp, Homo sapiens
cagcaattacttgcctgaggaagggaaggcctcctcctttaagaaaagaataggctgggtgcggtggctcatacttgtaatcccagcattttgggaggctgaggagggtggatcacctgaggtcaggagtttgagaccagcctaaggaacatggtgaaaccctgtctctactaaaaatacaaaaattagccaattgtggcacgcgcctgtagtcccggctactcaggaggctgaggtgagaggattgcctgagcctgggaggtggaggttgcagtgagccgagatcgcgccactgcactccagcctgggcaacagagtaagactccgtctcaaaaaaaaaaaaaagaaagaaagaaaagagtagaaggcccaagcttagtccaatattatagcttcagcatcagagtagagaatgattcagagcatctgtccagtgtctgctgtagatccctcaaatccgtgtttggacgcttctggtaaggggtgtatggcagatgcacccgacagatgcacttggcagcaataacttatgcatacctgaagaatgaccctatggtctaagaagaatgtgtgttcagagctccaagctaaggaatctgggagtggccaacccagatatttcatttcttatctatgacgaacttctgaactgctcccacccccagcccatcctgtagaatgcaggccctacgaggcgatc

SEQ ID NO: 1327 - DNA, 700 bp, Homo sapiens
cccgacagatgcacttggcagcaataacttatgcatacctgaagaatgaccctatggtctaagaagaatgtgtgttcagagctccaagctaaggaatctgggagtggccaacccagatatttcatttcttatctatgacgaacttctgaactgctcccacccccagcccatcctgtagaatgcaggccctacgaggcgatcaaagccctttgttttaggttaaatgaaggttgcctggtggaggttgctaggggaaaggtgttaagtaaaaatgttatataaactgcatggtgttttttgtttgtttttgtttttttgagacagagtttttgctcttgttgcccaggctggagtgcaatggtgcaatctcggctcactgcaacctccgcctcctgggttcaagtgattctgctgtctcagcctcccaagtagctgggattacaggtgcccaccaccaggcccggctaattttttgtatttagtagagtcagggtttccccatgttggtcagcctggtctcaaactcctgacttcaggtgatccacctgcctcagcctcccaaagcgctgggattacaggtatgagccaccacgcctggccaattgcatgctttttacaaggagttttggttctcctgcccagcccactgccactggactgccctgtattgtaagtcccctcaataaaccttatgtctcag

SEQ ID NO: 1328 - DNA, 700 bp, Homo sapiens
catgttggtcagcctggtctcaaactcctgacttcaggtgatccacctgcctcagcctcccaaagcgctgggattacaggtatgagccaccacgcctggccaattgcatgctttttacaaggagttttggttctcctgcccagcccactgccactggactgccctgtattgtaagtcccctcaataaaccttatgtctcagtttctggttctaggtctcttcttcagcctcttgaacatggtgccatccctactgaagtcaatggggtctgacatgactaggggaacttgaacaaaatctgaaatagctgtttttttgttgccaaaatcactgtaagacattatttgcctcagccccagaacattgaattatatgacccaagagtggagaaacagagaagtctgtctgtgtcatcagacaatatcccaagtgggatgtcatcaccccaatgcatattggcatttgggcagagtagagcagcgtcagcctagcaagacttggcacaattctgttggattgcacaatagaatgagaaatcacatttctgctgttatgtgattctgcattttaactccagtttgtttggcctggacagacaggtaactagccatgaagacaatggaccttgaaacattctgaagactagaaaaagtatgtaataaaatactttgaacaactgtttaaggacttaaatgtccag

SEQ ID NO: 1329 - DNA, 700 bp, Homo sapiens
ggcacaattctgttggattgcacaatagaatgagaaatcacatttctgctgttatgtgattctgcattttaactccagtttgtttggcctggacagacaggtaactagccatgaagacaatggaccttgaaacattctgaagactagaaaaagtatgtaataaaatactttgaacaactgtttaaggacttaaatgtccagactgtttctttagatgagtgtaatttccaatgtgaaaccccacaattcggcttcaagaggtacaggacagtttttgaattccacagaaaaaattttgcattgcaacaaacttgaccatcctatttgtggtagtagaaatgtaaattcattcccctcagagatacctgcaaaaatgaaatgtgaaatattctgcttgcattttaaagactggttattgcattctagaatagatggaaaagacattagtgagggccaatatagaaatatgagttttcccaaaagacttttatgtatatatatgacatggcaggaaaattgggtcactagtggtttttacttcttcgttcatttggcaaacatatgaatagactgatgtgtgccaaacactgttccgagttctgggaactgaggaaagaaacaagctatctgttttcatggagctcgtattttacttggaggatggagaggctgacaataaacttgtacaaataaatacaaa

SEQ ID NO: 1330 - DNA, 700 bp, Homo sapiens
atgacatggcaggaaaattgggtcactagtggtttttacttcttcgttcatttggcaaacatatgaatagactgatgtgtgccaaacactgttccgagttctgggaactgaggaaagaaacaagctatctgttttcatggagctcgtattttacttggaggatggagaggctgacaataaacttgtacaaataaatacaaacttcaagtagtggtaattgccaaggtgaaagaaaagagagtaatggtatagaatgacagtcattgggtagctgctttagatgaatggtaagtgaacatgtttctgagaaagtgatatctgagctgagaggcaaaggacgagaaggaatctgtcatgtgaagatctgggaagcaggtgtactaagcagaagagcagcaagtacaaagactgtgaggtaagggatgtgctcggggtgactaagtaacggagagaagaccagcgtgactagaacatagtgatcaaagtgagtaatgttggaacataagtcagagacattggcaggaggccagtttttatggaagccaaattgtctagtgccttgtagatagtggcaaggagtttggattttattctagatggaacactaccagaatattttttcttttttgagacagggtctcactgtcacccaggctggagtgcagtggcatgatcttgactctctgcaacttctgcctcc

SEQ ID NO: 1331 - DNA, 700 bp, Homo sapiens
acataagtcagagacattggcaggaggccagtttttatggaagccaaattgtctagtgccttgtagatagtggcaaggagtttggattttattctagatggaacactaccagaatattttttcttttttgagacagggtctcactgtcacccaggctggagtgcagtggcatgatcttgactctctgcaacttctgcctcctgggcttaagtgatcctcacacctcatcttccccagaagctaggactacacgcaccacacctggctaatttttgtattttttgtagagatgggattttgccatgttgcccaggctggtcttgaatgctgcccactttggcctcccaaagtgctaggattataggtgtgggccaccgtgcctggcctatcagagtattttcaggcagagaaaagcataaggtcttacttctagcataaaaggaacattctggctgctatatagagaagggactgtagaggacaagaatgaaagcaggttgactgattagaaagcattgcagcattataggcaagagcttatgatggcctgaactagagtggtaactgtggaagagataaatggatgaattcagaatatttttggaggaaaaaggtgacatgatttactattggatgtgggcatgagggaaggaaattaaggatgactcctggatttttagcctgagcaactttatagctt

SEQ ID NO: 1332 - DNA, 700 bp, Homo sapiens
gactgattagaaagcattgcagcattataggcaagagcttatgatggcctgaactagagtggtaactgtggaagagataaatggatgaattcagaatatttttggaggaaaaaggtgacatgatttactattggatgtgggcatgagggaaggaaattaaggatgactcctggatttttagcctgagcaactttatagcttttcatgtttgtttttgaaatggggagatttgatggggtgggggtttgggaaattaagagttttttatttttattttttgctttttaaaaattgtggtgaaatacacataacataaaatttaccattttaaccactcttaagggcattaagtacattcacattgtgcaaccatcaccatcatccatctgtagagaactcttttcatcttgcaaaattgaaactctgtacctattaaacactaactccccactcccctccttaccctagccccgaaaacccttctataatacagaagtctctatgaatttgaccactctcataagtggaatcacatagtatttgtccttttgtgactcgcttttattgtcacttagcataatgtcttcaaggttcatccatgttgtagcatatgtcagaatttccttcctttttaagactgaataatatgccattatatatgtatactacattttgtttacccattcatccactgatggac

SEQ ID NO: 1333 - DNA, 700 bp, Homo sapiens
ctatgaatttgaccactctcataagtggaatcacatagtatttgtccttttgtgactcgcttttattgtcacttagcataatgtcttcaaggttcatccatgttgtagcatatgtcagaatttccttcctttttaagactgaataatatgccattatatatgtatactacattttgtttacccattcatccactgatggacacttgggttgcttccatcttttgcctgttgtgactaatgctgctgtgaacatgtatgtacaagtatctatttgagtacttgcttttaattctttgggtatatacccagaagtggaattgctggatcatgtggtaattctatgtttaatttttttaaggaattgccatactgttttccccggtagctgtaccattttacattcccaccaacagtgcacaagagttccagtttctccacgtcctcgccaatacttgttattttctgtggttttgctgttgttgttgttttgtttgtttttgtttttttacagaagctatcctaatgggtataaagtggtatttcattgtggttttatttgcatttccctaattattaattatgttgagcatcttttcatgtgcttattggcaatttatatattttctttggagaaatgtctactcaactcttttgcccattttaaaatcaggttttttttttgttgttgttgaattgtagg

SEQ ID NO: 1334 - DNA, 700 bp, Homo sapiens
gtttttttacagaagctatcctaatgggtataaagtggtatttcattgtggttttatttgcatttccctaattattaattatgttgagcatcttttcatgtgcttattggcaatttatatattttctttggagaaatgtctactcaactcttttgcccattttaaaatcaggttttttttttgttgttgttgaattgtaggagttctttacatatttgggatatgaaccacttatcagatacatgatttgcaaatattttctcccattctatgccttttcactattgattatatccttttacgcacagaagttttacatttttgatgtagcccaatttttctattttttcttttgttgcctgtgcaagagttttattttaaatgcaattttgggatgtctattagacatccaagtcaaaatgtcaaatagacggctggatatatgagtctgaaggtcataaaagagatcagaatgagatataaattagggaatcattcacatatagatggtatttaaggccatgggtctggacagaatcacccaggagagaagtcatataggaacacataggtttccctagggaatacagtcatcttagagtaaaattccatcgaaggagatcaggaggtcttggctgagttaaatttggataatataagttattaactatgttaatgtgttctaagctagatgccaggt

SEQ ID NO: 1335 - DNA, 700 bp, Homo sapiens
catatagatggtatttaaggccatgggtctggacagaatcacccaggagagaagtcatataggaacacataggtttccctagggaatacagtcatcttagagtaaaattccatcgaaggagatcaggaggtcttggctgagttaaatttggataatataagttattaactatgttaatgtgttctaagctagatgccaggttaaggcagaaattaggaggtcctgggcaagtatcaatttgctctgctattgtattattacaagaataatactaacaatagtacatgacctcatttcatcctcacaatagctttacgcgattgatattcttgtcttcactttacaggcaaagaaacaaaagagaagtaaagtaatttacccagttgctatagttagcatgtggtaggtccatattagaggtctggtctgtctgcatgatggttaattttatgagatagcaagtaaaacattatttgtgtctgtgtctgtgtctgtgaggatgtgttcggagaggttcacaagcatttgaatcagtagacggagcaaataaggtccgccctcaccaatgtgggcaggcatcatccaattcactgaggactcctgctcacacagaacaaaaagtcagaggatgtgcctatagttccagcttcttggaaggctgcggcaggaagatgctggggcccaggagtttgaggccagc

SEQ ID NO: 1336 - DNA, 700 bp, Homo sapiens
atgtgttcggagaggttcacaagcatttgaatcagtagacggagcaaataaggtccgccctcaccaatgtgggcaggcatcatccaattcactgaggactcctgctcacacagaacaaaaagtcagaggatgtgcctatagttccagcttcttggaaggctgcggcaggaagatgctggggcccaggagtttgaggccagccagggcaacatagtaagacctttctctttaaaaaaattttttttggctgggtgcagtggctcatgcctgtaatcccagcactttgggaggccgaggcaggcggatcatgaggtcaggagatcgagaccatcctggctaacatggtgaaaccccgtctctaccaaaaatacaaaaaattagccgggcgttgtggtgggcacctgtagtacccgctactcaggaggctgaggcaggagaatggagtgaaccccggaggcggaggttgcaatgagtggagattgcaccactgcactccagcctgggcgacagatcaagactccgtctcaaaaaaaaaaaaatttttttttaaggcataggaagggcaaattctctcattctctctcttcttgagctgggacatccattttctcctgccttcaggaaatcagagctccatgttcttggatctcccgactctgggacttacaccttacccttttcccctcagtctttcagactt

SEQ ID NO: 1337 - DNA, 700 bp, Homo sapiens
ctgggcgacagatcaagactccgtctcaaaaaaaaaaaaatttttttttaaggcataggaagggcaaattctctcattctctctcttcttgagctgggacatccattttctcctgccttcaggaaatcagagctccatgttcttggatctcccgactctgggacttacaccttacccttttcccctcagtctttcagacttggactgaattacaccatcacctttcctggttctccagcttgcagatagcatgtcatgggacttcttagcctctgtaatcatatgagccagttcatatagtaaatctcctcctattgatctatacctatatctgtaatcctattagttgggtttctttggaaaactctaatacccccttatccacagtttttttttttttctgcagtttcagttatctacggccaactgggtaaaccaaataggtgagtacagtacaataaaatattttgagagagagatgcacatttgcatgacttctattacagcatattgttataatcattctattttattagctattgttagtctcttattctgcataatttataaattaaattttatcttaggtacgtatgtatgtatgtataggaaaaaacctagtatatatagtgttcagtactatctgaggtttcaggaatcccctggtgttcttggattgtagccccctgccttcaagcct

SEQ ID NO: 1338 - DNA, 700 bp, Homo sapiens
attacagcatattgttataatcattctattttattagctattgttagtctcttattctgcataatttataaattaaattttatcttaggtacgtatgtatgtatgtataggaaaaaacctagtatatatagtgttcagtactatctgaggtttcaggaatcccctggtgttcttggattgtagccccctgccttcaagcctgcactctcaattactgatgctacatctcattaccctgaaagatgaaatctagccttgagcccttaccaactggctgcattagatcattttagatctccatgtcaccgcagtcacatttgtgtgtggtgaatggtccaggagagatggtgctattcctgccaccttcattagcctggcttgcattctcttctgaacacttgggtcttattaacactgtgccaggttctcatataccccaaataaagaaaaagaaagtagatggatacagtgtacatactaggcccaacagaagttatgcttttactccctttcctcttcaatttagatactactatggccctttgcttccgtctatctcagttccttcgttgtcttatcattccattcacctctactgcaaggccctaaatccaaccatttggtcactgtactcctaccctgggtcactggaggaaatcacacaaccatgtgagttggtgtcttgacacatttacatttc

SEQ ID NO: 1339 - DNA, 700 bp, Homo sapiens
ttttactccctttcctcttcaatttagatactactatggccctttgcttccgtctatctcagttccttcgttgtcttatcattccattcacctctactgcaaggccctaaatccaaccatttggtcactgtactcctaccctgggtcactggaggaaatcacacaaccatgtgagttggtgtcttgacacatttacatttccaatcacaattggaccctcagcccacttgttactctctcaacccatgtttccttgcacccatcaacagccccccttctttcttgtatcttaagtcagcatcctggattgagagtgaagagtaaaatggtttgacttattgtgagcttagcctttgcaagactagtaaacaaaaggactggggtagtggcaagagtatgaatgggctggagggatcacaaggtataaactgaaagggaaaggaaatgatatcaggtgagagctgaagagttgggaggaaaacaaaggtcctagagtgagatggagctgttgtgactgatgagaggcccagggtgtgtcctcagcagcaagagtgtgaagtataggtgaaggtcaagtactgcgaggctaaggtgtagcactactcatcttcctgagcacaaaagtcaccagcaccttgggctgggtgtcagagagctcacagaatgtggataaccaaccaggcagatgttggtaacagca

SEQ ID NO: 1340 - DNA, 700 bp, Homo sapiens
atggagctgttgtgactgatgagaggcccagggtgtgtcctcagcagcaagagtgtgaagtataggtgaaggtcaagtactgcgaggctaaggtgtagcactactcatcttcctgagcacaaaagtcaccagcaccttgggctgggtgtcagagagctcacagaatgtggataaccaaccaggcagatgttggtaacagcaaccaggagggcacagcacaaacctgagcaggtcttttatgtatgtgaaggtgaaggagttatgatttagaaatggcagtgggaagcaaggagaatgctgagagcctgctcagctcttgtcttccaggatcatggatagtgcaaaatgagtagccttcctttgagagacagagccatgaggctagtggagtgctcagaaagaagccagatctctatcaaggaaaggagatggagagaacaaccagggatgtacttgaaagaggagagttgcatgtctacaatggaatatgtgttgcagaggactcagtcacagagaagacaactgcaggagggtgagctggagggctctgcaggggcaggagcacagtagggcattagaatgggagttttagatgagaaggattacatttgcagtgctggaggaagatcatctcaaggttcacaaaatcaagctttaaacttgtctgtgtcaacagacggaggcattgggtgatagttca

SEQ ID NO: 1341 - DNA, 700 bp, Homo sapiens
ggactcagtcacagagaagacaactgcaggagggtgagctggagggctctgcaggggcaggagcacagtagggcattagaatgggagttttagatgagaaggattacatttgcagtgctggaggaagatcatctcaaggttcacaaaatcaagctttaaacttgtctgtgtcaacagacggaggcattgggtgatagttcaaatccccataattttttataatcctttcagcagtctgttaaatataaccttggtgataagctaagttacctcagcatagcaagcttggcttggtctaaatcagggtagaggtgattgctgctcaaaggaagtgagagagacacccagctctggattggagaacatgactttgacctgggtttcagcctccacagggctaagccccaggggagcactgggcaagttgctaaggccacaagcaggagtttataaccaggctagactaagcccactgatgcaagaattttttttttttttttttgagacagagtctcactctgtcacccgggctagagtgcagtggtgtgatcttggctcactgcaacctccgcttccctggttcaagtgattctcctgcctcagcctctcaagtagctgggattacaggcacccgctaccatgcctggctaaattttgtatttttttagtagagacagggtttcaccgtgttggccaggat

SEQ ID NO: 1342 - DNA, 700 bp, Homo sapiens
tttgagacagagtctcactctgtcacccgggctagagtgcagtggtgtgatcttggctcactgcaacctccgcttccctggttcaagtgattctcctgcctcagcctctcaagtagctgggattacaggcacccgctaccatgcctggctaaattttgtatttttttagtagagacagggtttcaccgtgttggccaggatggtcttgagctcctgacctcaagtgatccacctgccttggcctcccaaagggctgggattactggcttgagccaccatgcccagcctgatgcatgaatttgcattcttcatgctcttcatctatgcttctgaagacctggcacttagtcaacactcagtaagtttttattttttaactgctttatgattataaaagtaatatatgaagcatttgtaaagtatggaaatctggaaaaaataaaacagaagtcatctataatctgaccatccaaacatacctactgttaataccttagtctacgttctttctttttttcctttttttgagatggagtcttgctgtgttgcccaggctggagtacaatggcatgatttcggctcactgcaacctctgcctcccaggttcaagcagttctcctgcctcagcctcccaagtagctgggcttacaggcatccaccaccatgccctggtaatttttgtatttttagtagagatggg

SEQ ID NO: 1343 - DNA, 700 bp, Homo sapiens
tacgttctttctttttttcctttttttgagatggagtcttgctgtgttgcccaggctggagtacaatggcatgatttcggctcactgcaacctctgcctcccaggttcaagcagttctcctgcctcagcctcccaagtagctgggcttacaggcatccaccaccatgccctggtaatttttgtatttttagtagagatggggtttcgccatgttggccaggctggtctcaaactcctgacctcatgtgatctgcccgcctcagccttccaaagtgctaggattacaggtgtgagccaatgcgcctggcctttttttttttttaagacagttttgctctttttgcccaggctgtagtgcagtggtgtgatcttggctcactgcaaccaggttcaagtgattttcctgcctcagccttctgagtagctgggactacagacgccaccatgcccagctaatttttttgtatttttagtagagatgggggtttcaccatattggccaggttggtctccaactcctgactttgggtgatccgcccacgttggcctcccaaagtgttgggattacaggcatgaaccactgtgcccagctgagcctactttcttctggtctttttctcatgcctccccaccaccaccccagccccccgccattacatacgtatatatgtttattttttttttaaagagatgaagtctt

SEQ ID NO: 1344 - DNA, 700 bp, Homo sapiens
ccaggttggtctccaactcctgactttgggtgatccgcccacgttggcctcccaaagtgttgggattacaggcatgaaccactgtgcccagctgagcctactttcttctggtctttttctcatgcctccccaccaccaccccagccccccgccattacatacgtatatatgtttattttttttttaaagagatgaagtcttgctctgttgcccaggctggtaggctgatctcaaactcctggcttcaggtgatcctcctgtgttggcctcccaaagtgctgttgttacaggcataagccatcacacctggctatttttcacgctttaaaaactcactttattcattcatttattcactcattctttgattaacactcatatactggttttattttattattttatatttttagctacagggtctcactctgtgcccgaggctggagtgcagtggcatgatcatgactctgcaaccccgaactcctgggctcaagggatcctcccaactcagcctcccaagaagttaggattacaggcacatgctaccacaccctgctaatttttttaaattaatttttttcttccttttttttttttttttttttttgtagaaccagtgtgtgttaggccattcttgcattactataaagaaatacctgagactgggtaatttattaagaaaagaggtttaattgactca

SEQ ID NO: 1345 - DNA, 700 bp, Homo sapiens
ctcccaactcagcctcccaagaagttaggattacaggcacatgctaccacaccctgctaatttttttaaattaatttttttcttccttttttttttttttttttttttgtagaaccagtgtgtgttaggccattcttgcattactataaagaaatacctgagactgggtaatttattaagaaaagaggtttaattgactcacgatttcacaggctgtataggaagtgtggcactaggcatctgctcagcttctagggaggcctcagggagcttttactcacagtggaaggtgaagggggagcaggtgtgtcacatggtaaagacaggagcaaggtggggggaggtgccacacccttaaacaaccagatttctcaagaactcacttattatggtggggacagctccaagccatgagggatctgcccccatgaccaaaacacctcccagcaggccccacctccaacattagagattacatttccacatgcgatttggacagggataaatatccagactatgtcattttgcccctggccctcctaaatctcatgtccttctcaagttgcaaaatacaatcatgccttcccaagagttccccaaagtcttaactcattccaatgttaactccaaagcccaaaattcaaagtctcatctgagacaaggcaagtctcttccacctatgagcctataaaatcaaaaa

SEQ ID NO: 1346 - DNA, 700 bp, Homo sapiens
ggataaatatccagactatgtcattttgcccctggccctcctaaatctcatgtccttctcaagttgcaaaatacaatcatgccttcccaagagttccccaaagtcttaactcattccaatgttaactccaaagcccaaaattcaaagtctcatctgagacaaggcaagtctcttccacctatgagcctataaaatcaaaaacaagctatatacttccaagttacaatgggtgtataggcattgggtaaacatgcccattccaaaagagaaattggccaaaagaaaggggctacaagctccatgcaaattcaaaacccagcagggcaattattaaattgtaaagctccaaagtaatcttctttgactccgtgtcccatatccagggctcactggtgcaagaagtgggctcgcaaggccttgggaagcttcgcccctgtagtttgcatagtacagcctccacagctgctcttatgggctagagttgagtgcctgtggcttttccaggcacagggtgcaagctgccagtggatctaccattctcaggtctggagggtggtgacccctttctcacagctccaccaggcagttccccagtggagactgtgtggggccttcaaccccacatttcccctccaaactgccctagtaggggttctctgtgagggttccacccctacagcaggcttctgcctgggtaccc

SEQ ID NO: 1347 - DNA, 700 bp, Homo sapiens
tccaggcacagggtgcaagctgccagtggatctaccattctcaggtctggagggtggtgacccctttctcacagctccaccaggcagttccccagtggagactgtgtggggccttcaaccccacatttcccctccaaactgccctagtaggggttctctgtgagggttccacccctacagcaggcttctgcctgggtaccctggctttcttgtacatcctctgaaatctaggtagaggctgccaagcctccttcactcttacagtctgcatgcctgcatgcttaacaccacatggaagctgccaaagcatatggcttttgctctttggagcagcagcctgagctgtacctgaggccccttgagccacagctggagctggaacagcctggatgtagggagcactgtcctaaggaggctgtgcagagccatggggtcctaggcctagcccatgaaatgattcttcctcctaggtctctgggcctgtgcctgtgatggcaagggctgcccctgagatctctgaaatgccttcaaggcctttttcccattgtcttagctattagtacctggctctcttttagttattcaaatttctctagcaagtggttgctccacagcctgcttgaattcctctactgaaaatgcttctgctttctctatcacatggccaggctgcaaattttctaaagttttacactctgct

SEQ ID NO: 1348 - DNA, 700 bp, Homo sapiens
ggctgcccctgagatctctgaaatgccttcaaggcctttttcccattgtcttagctattagtacctggctctcttttagttattcaaatttctctagcaagtggttgctccacagcctgcttgaattcctctactgaaaatgcttctgctttctctatcacatggccaggctgcaaattttctaaagttttacactctgcttcccctttaaatataacttctaactttaagtcattttttttgctctcacatctgagttaagctgttagatgcagccatgtaacttcttgaacactttgctgcttagaaatttcctctgccagataccctagttgtcactctgaagttcaaacttccacagatccttacagcatgaacaaagtgcagccaagttctttgctaggccataatgagggtggcctttgctccatttctaggttcctcatttccatctgagacctcatcagccacgccttcactttccatatcaccatcagcattctggttacaaccatttgaccagccaagtactattctaacttctgagaatacagaagtgctcctcatggaacttacagtctagtggaggaagaaggacaataaatgcaacaaagaagtaaattagtcaggatgtcagagagtgataagtcccatggagaaaaatgaagcaggagaaaaatgaagcagggatgcataaagt

SEQ ID NO: 1349 - DNA, 700 bp, Homo sapiens
ttctggttacaaccatttgaccagccaagtactattctaacttctgagaatacagaagtgctcctcatggaacttacagtctagtggaggaagaaggacaataaatgcaacaaagaagtaaattagtcaggatgtcagagagtgataagtcccatggagaaaaatgaagcaggagaaaaatgaagcagggatgcataaagttagttcagagagagaacaggatacaattttaaatagtgtggtcagataagggtttattaaggaggtggcatttgggccaagacactaaggaagtaagagaacaagctatgtagatagctgggaagagcattcctaggaagagggaacaagtatctaatagagaagcatgtctagtatgttcaaagaatagcaaagccttggtagccttaatgaagaaagcaatggagagagtaataagagatgatgtcagcgagctaaaggagggcatgaagattagagtagggccctataaactggatgaccactgtcaaatgaaattaaggctgttgaggcagaaatgatttgataaaagtttattggaagccaaatgtgaggatgaacccaggaaaacacaccaacaaagttgagagtgttctggagtctgttacaagttggaaagttagaagacaggagggggactcttcatacaggagttgtcctttttcactggagggtacaa

SEQ ID NO: 1350 - DNA, 700 bp, Homo sapiens
tgaccactgtcaaatgaaattaaggctgttgaggcagaaatgatttgataaaagtttattggaagccaaatgtgaggatgaacccaggaaaacacaccaacaaagttgagagtgttctggagtctgttacaagttggaaagttagaagacaggagggggactcttcatacaggagttgtcctttttcactggagggtacaatacaaaggttacaataattggctacagattgcaacatgcagactaacatgtctacatgcaagacaatcagtaaaatgttatgactcagaaataaatcagtgtccttttcagtgtcagtaggtggtgcattgatcagtacatcaacaatttgaggaacttctaagattccttactcaggacaaggtatcgccatgaatcacaagaccttcccaagatgggttaatttggaagctgtttacttttaaagtaaactgtcaaatgtgacctgtaggttattgccatatataatttgtcatccaaattaggagacttctagaatgaaagttggaggtgagggttattaatcattaacactagggctggttgccgtggctcacgcttgtaatcccagtactttgggaggctgaggcaggcagatcacgaggtcaggggattgagaccatcctggccaacatggtgaaaccccgttctctactaaaaaatacaaaaaaaaaaaaaa

SEQ ID NO: 1351 - DNA, 700 bp, Homo sapiens
aaattaggagacttctagaatgaaagttggaggtgagggttattaatcattaacactagggctggttgccgtggctcacgcttgtaatcccagtactttgggaggctgaggcaggcagatcacgaggtcaggggattgagaccatcctggccaacatggtgaaaccccgttctctactaaaaaatacaaaaaaaaaaaaaatttagctgggcatggtggcacatgcctgtaatcccagctactcagaaggctgaggcaggagaattgcttgaaccagggagtcggaggttgcagtgagctgagatcatgccactgcactccagcctggcaacagagcgagactccgtctcaaaaaaaaaaaaaaaaaaagttaacactagttcagtggagagaagccaggactgtgctggacaaactctgacgtgtaatcattctacttatagaccattgtaaggacttgggctttcaaaaaatctgactgagatgggaagcgattggaaggttttgagcagaaaagtaacatgatgtgattgagatatccctgactactatgctgagagtagattgaaggggcgtaggagcagccttaatgaagaaggattggctgggggctaacagaatgcagggaagaaactggattctgcatatgttgaaattatggcaaaagattttattgacagattggatgtggagtacaaga

SEQ ID NO: 1352 - DNA, 700 bp, Homo sapiens
aggttttgagcagaaaagtaacatgatgtgattgagatatccctgactactatgctgagagtagattgaaggggcgtaggagcagccttaatgaagaaggattggctgggggctaacagaatgcagggaagaaactggattctgcatatgttgaaattatggcaaaagattttattgacagattggatgtggagtacaagaggaagagcagccaggaaaataaagtttccatttactgagttggggaggacttcaggaagagcagatttgggatgaaattaggagcacatgttaaatttgacatgttatgtttgagacacctattatatatccaagtgaggatatcaagtgggcagttattatgtgagcctggagttcactctctctatgtgttggtggtcatcagtgcagagatgatatttaaatcatgagactggattttttaaaaaggaagaggactgaagactaagttctgggcactccaattttgggcagtagcggagatgaagaaaaaccagcacactagatggtaaaggagcagccaacaaggtaagaggaaaaccaagcaagtgtcatttttgttgatttttttgatacagagtctcactctgtcactcaggctggagtgcaatgacacaatctcggctcactataacctctgccttctgggtccaagtgtttttcttgcctcagcttccca

SEQ ID NO: 1353 - DNA, 700 bp, Homo sapiens
ggagatgaagaaaaaccagcacactagatggtaaaggagcagccaacaaggtaagaggaaaaccaagcaagtgtcatttttgttgatttttttgatacagagtctcactctgtcactcaggctggagtgcaatgacacaatctcggctcactataacctctgccttctgggtccaagtgtttttcttgcctcagcttcccaagtagctgggactgcaggtgtgtgccaccacgcctggcgcaagtgtcatgtagaaagcagttcaaggatgaaagagaaatgagtttgtcaaatgccttgagaggtcaggtaagatgatgactgtgaattgactattgaattcagaaacatgcaggtcactgcggaccttgatagaggtgctctggtgaaaggtgagggctaaagcttaattgtagtggggccaagtgaaaattggaagaacaaagttgaaagtagcaagtagatatagcaatcttccaaggagtttcactgctaagggacagggagaaatggggcaggagctgacagcagaaactgggtcaagagagagcttttacagcctctttgcatactgaatgggaaagatccagtagagagggaaaagatttatgatgggggagtcaggagaattgctagagcaacatgtgctcctaatttcatcccaaatctgctcttcctgaagtcctccccaactcagtaa

SEQ ID NO: 1354 - DNA, 700 bp, Homo sapiens
acagggagaaatggggcaggagctgacagcagaaactgggtcaagagagagcttttacagcctctttgcatactgaatgggaaagatccagtagagagggaaaagatttatgatgggggagtcaggagaattgctagagcaacatgtgctcctaatttcatcccaaatctgctcttcctgaagtcctccccaactcagtaaatggaaactttattttcctggctgctcttcctctcgtactccacatccaatctgtcaataaagtcttttgccataatttcaacatatgtagaatccagtttcttgcctgtattctgttagcccccagccaatccttcttcattaaggctgctcctacgccccttcaatctactctcagcatagtagtcagggctatctcaattacatcatgttacttttctgctgttggtaagggagtagggggtgggggaggggtaagaagtatataaggctggggccgggcacagtggctcacacctataatcccagcactttgggaggctgaggcaggccaatcacttgagcccaggagttcagtactagcctagccaacatggcaaaaccctgtctctactaaaaatacaaaaattagctgggtatggtggtgcatgcctgtaatcctagctacttcggaggctgaggcatgagaatcgtttgaacctgggaggcagaggttgca

SEQ ID NO: 1355 - DNA, 700 bp, Homo sapiens
tataatcccagcactttgggaggctgaggcaggccaatcacttgagcccaggagttcagtactagcctagccaacatggcaaaaccctgtctctactaaaaatacaaaaattagctgggtatggtggtgcatgcctgtaatcctagctacttcggaggctgaggcatgagaatcgtttgaacctgggaggcagaggttgcagtgagccactgcactccagcggggaggagagaccattcaggagaaacgggagaaaagacagagggtgtgggtacagatggagttaggctggtggattatgctgcttgtagaggttctctccattgcttctattttctaggtgaaataggaagccaaggcacagctgagggtgatcatgggggaggaggtgatggagttctgaagagaaagaaggtcttccaggatagagaatgaaccagggcaattaggatcctcttgaagtcactgatggtcagtttaaagtgaaaccagtcagatggaatatattttccatctacatttggctatgcaggtgctagcaagaagtaggagggaggttagatttaaccagctttatagtttcccacaaaagcaaggcagataagaaaggggcaaggaagatgattatgatgattaagcatggaatttaagctggccaagaaggggtgtgaggacatgagtaagatgagagatagcaaaa

SEQ ID NO: 1356 - DNA, 700 bp, Homo sapiens
gaatatattttccatctacatttggctatgcaggtgctagcaagaagtaggagggaggttagatttaaccagctttatagtttcccacaaaagcaaggcagataagaaaggggcaaggaagatgattatgatgattaagcatggaatttaagctggccaagaaggggtgtgaggacatgagtaagatgagagatagcaaaaacgtggacatctttgccaggtatggagccaaacacagtatgcattgtctcatgtaatccccacccaaatggaattgttatcatccctctttacagatgaagaagctgagttttagggaagactgtaacttgctcaaagtcacacagctgatagagaagtgacacacccagcatcaggtcctggaacacttgtctccaaaggctatgtacttagccctatttgctttaactggagtattagtgggcattacaaaaattgatgcatatgtacaaaggatggtaattttgtccagtatgtttttgttaatacttttccaacttgagttaattttaagattttctgttgtacagaattctttaaaagtttatagtaaaatctatttatcttcaatttcctattcatcttaaaattaaatgtcacctatattttcttctagcttttgatttatttactcttggctctattttatttacatttattacatttggctctttagttg

SEQ ID NO: 1357 - DNA, 700 bp, Homo sapiens
tttgttaatacttttccaacttgagttaattttaagattttctgttgtacagaattctttaaaagtttatagtaaaatctatttatcttcaatttcctattcatcttaaaattaaatgtcacctatattttcttctagcttttgatttatttactcttggctctattttatttacatttattacatttggctctttagttgatcaggaattaatttggtatgtggtttatggtgggatactatttattcccccagtttttccatttttaccagttcttcagcttgtcgattgtcccagcaccagtcttcaacaatgtatcattttcttgataatttataattcatctttatcatatgttacaatttttcaacacttgggtctgtttctgtgatacctcttctatttcgttgattgatttatcttttgtgtgtgtgtctgtgtgtgtgtgtgtgtgtttgtgtgttttccaggaaacccagagtagtgtagtcattgtgtgtttttatatatgtaagagaacatttccccttatcaatgatctttttcaaaaatttcttaaacatattacatatttcttttttcagatgctctttacaaatattttttaacttcttaaaatatctcattgaggattccgttccaagatggccaaataggaacagctctggtctgcagctcccagtgtgatcgacgcagaag

SEQ ID NO: 1358 - DNA, 700 bp, Homo sapiens
gtttttatatatgtaagagaacatttccccttatcaatgatctttttcaaaaatttcttaaacatattacatatttcttttttcagatgctctttacaaatattttttaacttcttaaaatatctcattgaggattccgttccaagatggccaaataggaacagctctggtctgcagctcccagtgtgatcgacgcagaagacggatgatttctgcatttccaactgaggtacctggttcatcttactaggactggttggacagtgggtgcagcccacggagggtgagccgaagcagggcagggcatcgcctcacctgggaagcgcaaggagtcaggggatttccttttcctagccaagggaagccgtgacagatggtacctggaaaaacgggacactcctgcccaaatactgcgcttttccaaagtcttagcaaatggcacaccaggagattatatcctgtgcctggctcgacagatcctatgtccatggagccttgctcactgctagtgcaacagtctgagattgacctgcaaggcagcaacctggcatggggaggggcatccgccattgctgaggcttgagtaggtaaataaagtggctgtggaagctcgaactgggtggagcccaccacagctcagcaaggctgactgcctctgtagtctccacctctggggcagggcatagctgaacaaaaagca

SEQ ID NO: 1359 - DNA, 700 bp, Homo sapiens
tcactgctagtgcaacagtctgagattgacctgcaaggcagcaacctggcatggggaggggcatccgccattgctgaggcttgagtaggtaaataaagtggctgtggaagctcgaactgggtggagcccaccacagctcagcaaggctgactgcctctgtagtctccacctctggggcagggcatagctgaacaaaaagcagcagaaacttctgcagacttaaacatccctgtctgacagctctgaagagagcagtggttctcccaggatggtgttttagcttggagaacagacagactgcctcctcaagtgggtccctgacccccatgtagcctaactgggagacacctcccagtagccgactgacacctcatacaggcaggtgcccctctgggatgaagcttccagaggaaggatcactcagcaatatttgctgttctgcaatatttgctgttctgcagcctctgatggtgatacccaggcaaacaggtctggagtagacctccagcaaactccaacagacctgcagctgagggacctcactggtagaaggaaaactaacaaacagaaagaaatagcatcaacatcaacaaaaaggacatccacaccaaaaccccatctgtaagttaccaacatcaaagaccaaaggtagataaaaccacaaagatggggagaaaccagagcagaaaagctgaaaatt

SEQ ID NO: 1360 - DNA, 700 bp, Homo sapiens
gacctccagcaaactccaacagacctgcagctgagggacctcactggtagaaggaaaactaacaaacagaaagaaatagcatcaacatcaacaaaaaggacatccacaccaaaaccccatctgtaagttaccaacatcaaagaccaaaggtagataaaaccacaaagatggggagaaaccagagcagaaaagctgaaaattctaaaaaccagagcacctcttctcctccaaaggatcacaactccttgccagcaatggaacaaagctgggtggagaatgactttgacgagctgacagaagtggacttcagaaggtcagtaataataaacttctcccagctaaaggaggatgttctaacccatcgcaaggaagctaaaaaccttgaaaatagattagacgaatggctaactagaataaacagtgtagagaagaccttaaatgacctgatggagctgaaaaccatggcacgagaactttgtgacacatgcacaagcttcaatagccgattcgatcaagaaaggatatcagtgattgaagatcaaattaatgaaataactcaagaagattagagaaaaaagagtaaaagggaacgaacaaagcctccaagaaatatgggactatgtgaaagaccaaatctacgtttgattggtgtacctgaaaatgacagggagaatggaaccaagttggaaaacactcctca

SEQ ID NO: 1361 - DNA, 700 bp, Homo sapiens
tagccgattcgatcaagaaaggatatcagtgattgaagatcaaattaatgaaataactcaagaagattagagaaaaaagagtaaaagggaacgaacaaagcctccaagaaatatgggactatgtgaaagaccaaatctacgtttgattggtgtacctgaaaatgacagggagaatggaaccaagttggaaaacactcctcaggatattatcaaggagaacttccccaacttagcaaagcaggccaacattcaaattcaggatatacagagaatgccacaaagatactcctcaagaagagcaaacccaagacacataattggcagattcaccaaggttgaaatgaaggaaaaaatgttaagcgcagccagagagaaaggtcgggttacgcacaaagggaagcccatcagactaacagcggatctctcggcagaaaccctacaagcccgaagagagtgggggccaatattcaacattcttaaagaaaagaattttcaacccagaatttcatatccagccaaactaagcttcataagtgaagaataaaatcctttccagacaagcaaatgctgagagattttgtcaccaccaggcctgccctaaaagagctcctgaaggaagcactaaacatggaaaggaaaaaccggtaccagccactgcaaaaatatgccaaattgtaaagaccatcgatgctatgaagaa

SEQ ID NO: 1362 - DNA, 700 bp, Homo sapiens
agaatttcatatccagccaaactaagcttcataagtgaagaataaaatcctttccagacaagcaaatgctgagagattttgtcaccaccaggcctgccctaaaagagctcctgaaggaagcactaaacatggaaaggaaaaaccggtaccagccactgcaaaaatatgccaaattgtaaagaccatcgatgctatgaagaaactgcatgaactaacaagcaaaataaccagctaacatcataatgacaggatcaaattcacacataacaatattaaccttaaatgtaaatgggctaaatgccccaattaaaagacacagactggcaaattggataaagagtcaagacccatccgtgtcctgtattcaggagacccatctcacgtgcagagacacacataggctcaaaataaagggatggaggaagatctaccaagcaaatggaaagcagaaaaaagcaggggttgcaatcctagtctctgattaaacagactttaaaccaacaaagatcaaacgggacaaagaaggccattacataatggtaaagggatcaattcaacaagaagagctaactatcctaaatatatatgcacccaatacaggaacacccagattcataaaacaagtccttagagacctacaaagaaacttagactcccacacaataataatgggagactttaacaccccactgtcaatatt

SEQ ID NO: 1363 - DNA, 700 bp, Homo sapiens
aacaaagatcaaacgggacaaagaaggccattacataatggtaaagggatcaattcaacaagaagagctaactatcctaaatatatatgcacccaatacaggaacacccagattcataaaacaagtccttagagacctacaaagaaacttagactcccacacaataataatgggagactttaacaccccactgtcaatattagacagatcaatgagacagaaggttaacaaggatatccaggacttgaactcagatctgcaccaagcagacttaatagacatctacagacctctccaccccaaatgaacagagtatacattcttctcagcaccacatcacacttattccaaaattgaccacatagttggaagtaaagcactccttagcacatgtaaaggaacagaaatcacaacaaactgtgtctcagaccacagtgcaatcaaattagaactcaggattaagaaactcactcaaaactgcacaactgcatggaaactgaacaatctgctcctgaatgactactgggtaaataacgaaatgaaggcagaaataaagacgttctttgaaaacaatgagagcaaagacacaacgtgccagaatctctggaacacacttaaagcacggtatatagggaaatttatagcactaaatacccacaagagaaagcaggaaagatcaaaatcaacaccctaacatcat

SEQ ID NO: 1364 - DNA, 700 bp, Homo sapiens
aacaatctgctcctgaatgactactgggtaaataacgaaatgaaggcagaaataaagacgttctttgaaaacaatgagagcaaagacacaacgtgccagaatctctggaacacacttaaagcacggtatatagggaaatttatagcactaaatacccacaagagaaagcaggaaagatcaaaatcaacaccctaacatcataattaaaagaactagagaagcaagagcaaacaaattcaaaagctagcagaaggcaagaaataactaagatcagagcagaactgaaagagatagagacacaaaaacttcaaaaaaatcaacgaatccaggagctcgttttttgaaaagatcaacaaaattgatagactgttagcaagactaataaagaagaaaagagagaagaatcaaatcgatggtataaaaagtgataaaggggatgtcaccaccaatcccacagaaatacaaactaccatcagagaatactataaacacctctacacaaataaactagaaaatctagaagaaatggataaattcctggacacatacagcctcccaagactaaaccaggaagaagttgaatctctgattagaccaataacaggctctgaaattgaggcagtagttaatagcccaccaaccaaaaacagtccaggaccagacagattcacagccaaattctaccagaggtacagaggag

SEQ ID NO: 1365 - DNA, 700 bp, Homo sapiens
caaataaactagaaaatctagaagaaatggataaattcctggacacatacagcctcccaagactaaaccaggaagaagttgaatctctgattagaccaataacaggctctgaaattgaggcagtagttaatagcccaccaaccaaaaacagtccaggaccagacagattcacagccaaattctaccagaggtacagaggagctggtaccattctttctgaaactattcctagcaatagaaaagagggaatcctccctaattcattttatgaggccagcatcatcctgataccaaagcctggcagagacacaacaaaaaaaagagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaagagaattttataccaatatccctgatgaacatcgatgcaaaaatcctcaataaaatactggcaaaccga

SEQ ID NO: 1366 - DNA, 700 bp, Homo sapiens
cgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaagagaattttataccaatatccctgatgaacatcgatgcaaaaatcctcaataaaatactggcaaaccgaatccagtagcacatcaaaaagcttctccaccacgatcaagtgggcttcatccctgggatgcaaggctgtttcaacatatgcaaatcaataaacataatccatcacagaaacagaaccaatgacaaaaaccgcttgattatctcaatagatgcagaaaaggccgtcgacaaaattcaaaagcccttcatgctaaaaactctcaataaactaggtattgatagaacgtttctcaaaataataagagctatatatgacaaacccacagccaatatcatgtggaatgggctaaagctgttgacctgatagatatgggttcaagaggacacagctgaatactgtgcttaggaaaagaacagtttcaaaggctttccagattgtcagatttgatgatatcctccttggtgcacacctctcttggctatggggcacataaaccacctctaccaatctaactggtttgtgcagtttttctgattttgtatctaccggcaaaatatat

SEQ ID NO: 1367 - DNA, 700 bp, Homo sapiens
cctgatagatatgggttcaagaggacacagctgaatactgtgcttaggaaaagaacagtttcaaaggctttccagattgtcagatttgatgatatcctccttggtgcacacctctcttggctatggggcacataaaccacctctaccaatctaactggtttgtgcagtttttctgattttgtatctaccggcaaaatatatcttaagccatttttaggaaacaggaggtttagtcacgtgctcaacaaaagcacaacaaatggggagcatttaatggtgtaagggctgtgaggtgtagctgctgaaactgtagctaggagctgccttgctgccttcttgcaggcagattggccagatgagccaggctaaaatacaattaatatctaccattgtggtttaatatgaaatatggatacctggtctttgtctcagttcttgtcatagagttccccaaacctttagaacttcctgagtggtaggaatatctcattagtgataatgagcccctttgattcgataactcctgagtttatgctaatgaggttacttaatgtggggccctagatattcttaggatggggctagttcccggaaagaccaggtcatttgaggattagagggttggaacttttagctctacccactgatctctgggtggggaaggtgctggagatcaagctgcctaaaaactcttgaacaa

SEQ ID NO: 1368 - DNA, 700 bp, Homo sapiens
tgagcccctttgattcgataactcctgagtttatgctaatgaggttacttaatgtggggccctagatattcttaggatggggctagttcccggaaagaccaggtcatttgaggattagagggttggaacttttagctctacccactgatctctgggtggggaaggtgctggagatcaagctgcctaaaaactcttgaacaacaagatttgaggagcttccagtaaatgcgtccacaagctgggagggcactgcaccccagtttcactgggacagaagctcttgcacttggaatctttccagacctagcccttcatgctgcttcatctggctgttcatctgtatcctttataataaattggcaaatgtaaaggtttagctgaatttggtgagcctttctagaaaattaattgaacctaagaaggggtctgtggaaaccctggtttgtagttggtaggtcagaggtgcgtgtggcttggatgttcgaatggcatctgaagagggacagagcacacaacctgtgggatctgacactatctccccgcagatagggtcagagcttaattctattagagaacaccccattggtatctgctggagaattacttggtgtatgagaagccccccaccacatctggtcacagaagtattgtgggttgagtgtgacagtacagggtaaaaagtggtttgttttttcctcta

SEQ ID NO: 1369 - DNA, 700 bp, Homo sapiens
gggacagagcacacaacctgtgggatctgacactatctccccgcagatagggtcagagcttaattctattagagaacaccccattggtatctgctggagaattacttggtgtatgagaagccccccaccacatctggtcacagaagtattgtgggttgagtgtgacagtacagggtaaaaagtggtttgttttttcctctaacagtgatcactccctctcaaaggagtgtggaaggttttctggataggaatactgcatataatcatttggttcacttcagaaactactataattttgactgtgctggttcacttccacatgtacaaacacacacacatacacacacattgttgtcacctaatatttgcgttaatacaatgatgttatttttatttggatagtatttgtatgattggaaatgagtgttaatctttatatgtattttaccagtccttgactaacatgttttcaagacatcttaccaatccatttcattgaattaatgagtaaggagactctctagaaatggttggtttgtaaagcaaggacattatctggaagaatcatccagagtttactgtatgacgagcatttcttgatagcaaggttcattttggtgtcaatcgttacagtcagtccatttcagtgggaacaacgaatttctccacagggtcttatttttctgtttttcacttcacc

SEQ ID NO: 1370 - DNA, 700 bp, Homo sapiens
attaatgagtaaggagactctctagaaatggttggtttgtaaagcaaggacattatctggaagaatcatccagagtttactgtatgacgagcatttcttgatagcaaggttcattttggtgtcaatcgttacagtcagtccatttcagtgggaacaacgaatttctccacagggtcttatttttctgtttttcacttcaccaaatggggtagatattttttcagaatgcagttattagaaccttgggattttcttctgtctccattgagtctcttgtttttttcccagatctgaacctgaaaataaaatagatgctaaggaaaattaaatattcaagactttcctcctcaaaatgctccatccaaattgacattgaaaaatatttctccaatcaatgaacaagtaactatttgaactctaatgagaacctcatggtgtagatctaatattttatgcttttaaacatctgaggctactttcttaattaagcatagaagccagaatttaaactctttcacagttttcccaagcaaaggatagagagggaggcatgaaattcttggcaattaaagttgatactgaagtagttctatcattagaagaaaacaacttatcaacaatgggcactttttgctataaatgttctgtcagggatcagaattaattcatatgcagagttacctttatcaaggccaggcac

SEQ ID NO: 1371 - DNA, 700 bp, Homo sapiens
agaatttaaactctttcacagttttcccaagcaaaggatagagagggaggcatgaaattcttggcaattaaagttgatactgaagtagttctatcattagaagaaaacaacttatcaacaatgggcactttttgctataaatgttctgtcagggatcagaattaattcatatgcagagttacctttatcaaggccaggcactgggaacactttatcttttataacctcaaaatagccgtatgaaatatcccatatagcagatgggaatactgaagcttagtgaatattaagtgatatgcccaaatttttgcagtagatttgggatttaaagccaggcagtgttactcgaaactctaaacttctcctaaataccactaatcttttaaatgtttgctgtggtgtcataaaaagatactggtctttgtccctggctcctaacatagagatcctaaatctcttataatttctggagtgatagggagtgataaaagcttcttttgttctaatgaggcaacccttggctgggcccttagatagcttcagggtgggggctggtcaccagaagactaagcctggattagaagcctggaacctctggggagaggagagaggctggggatagacttaataatccatcatgccaacatgactaaacctccatgaaaacctctaaatgatggggtttggagaacttccgagt

SEQ ID NO: 1372 - DNA, 700 bp, Homo sapiens
gttctaatgaggcaacccttggctgggcccttagatagcttcagggtgggggctggtcaccagaagactaagcctggattagaagcctggaacctctggggagaggagagaggctggggatagacttaataatccatcatgccaacatgactaaacctccatgaaaacctctaaatgatggggtttggagaacttccgagttggtgaccacatccacatgccaggagggcagtgcaccttaactccgtagggacagaacctctgcactcaggacccttccagacctctctgtatgtacctcttcatctggctgttcatttgtatcctttgtaagaaaccgctagtggccagtgttctgagtgctgtgagtcattctagcaaataatcaaacccaaggaggggatttgttggaaccccagacttggtagcaaagtcagagagaaatgtgggtaacctggggacctgacatttgtgagtggcaagtgaagcaaggcagtattgtgggactgagtctttacacctgtggagtctgatgctaaatttaggtattgtcaaaattgaactgcattataggacactcaataggtgtcagaattggtttgcgtcaagaagaaaaacccttgcgcaatctcataagccaaaaaaagatgttgaattgttttatttttgcatttccttattaatgtggacaaataacttt

SEQ ID NO: 1373 - DNA, 700 bp, Homo sapiens
tgtgggactgagtctttacacctgtggagtctgatgctaaatttaggtattgtcaaaattgaactgcattataggacactcaataggtgtcagaattggtttgcgtcaagaagaaaaacccttgcgcaatctcataagccaaaaaaagatgttgaattgttttatttttgcatttccttattaatgtggacaaataacttttttcatgtatatattggacactgaagtgacttcttctgtaaactgtctgttcttgtcctttgctggttttcctactgaattgtttgtctttttctcactggttactatgagctttttgtatattaagtatattagccttatgtttaggttttgtgtagcaaatattttctcctggcttattgacttttgtctttgtgggtggtttctttttgccttgccaataatttaaaaaatgtacaatcagatatatcaatctgttcctttatggttctttgattttatgttatgctcagtaagatcttctctaaggttataaaaatgtttgtttcctcctggtatatttatgattttacatttttaggcctaaattttttaactgtctggattttatcttgatgtgttttttttttggagacggagtctcgctctgtcacgcagactggagtgtagtggcgcgatttcggctcactgcaacatccaccaccctggttcaagcgat

SEQ ID NO: 1374 - DNA, 700 bp, Homo sapiens
tcttctctaaggttataaaaatgtttgtttcctcctggtatatttatgattttacatttttaggcctaaattttttaactgtctggattttatcttgatgtgttttttttttggagacggagtctcgctctgtcacgcagactggagtgtagtggcgcgatttcggctcactgcaacatccaccaccctggttcaagcgattctcctgcctcagcctcccgcgagctgggattacaggggtgcgccaccatgcctggctaatttttgtatttttagtagagatggggtttcaccatgttggacagactgttctcgaactcctgacctcaagcaatctgcctgcctcaatctccctaagtgctgggattacaggtgtgagccaccatgcccagccaatgcattttttaaagagacaactttttaatttattcaaaatgtctagctgaatgttctaataccttttactgaataactattcccccttgactttgctactttttattacatactgaatttttatattttcttgggttttatcctgaactctatcctattccattggtttctattcctataccattatcacattgttttaattactattgctcaacaatatgctttattactattattattatttttgagacagagtctagctctgttgcccagtctggagtgcggtggcatgatgttggctcac

SEQ ID NO: 1375 - DNA, 628 bp, Homo sapiens
tattacatactgaatttttatattttcttgggttttatcctgaactctatcctattccattggtttctattcctataccattatcacattgttttaattactattgctcaacaatatgctttattactattattattatttttgagacagagtctagctctgttgcccagtctggagtgcggtggcatgatgttggctcactgcaacctccacctcccgggttcaagcaattctcctacctcagcctcctgagtagctgggactacaggtgtgtgccaccatgcccagctaatttttgtatttttagtagagacagggtttcaccatgttggccaggatggtctcgatctcttgacctcatgatccgcctgcctcagcctcccaaagtgttgggattacaggcatgtgccaccgcgcctggcctattatttatttattttttttgagacggagttttgctcttgttgcccaggctggagtgcagtggtgtgatctcagctcactgcaacctctgcctcctgggtcaagcagttctcctgcctcagcctcctgagtagctgggattacatgtgactgccaccacacccagctaattttttgtatttttagtaaagatgaggtttcacta

SEQ ID NO: 1376 - DNA, 700 bp, Homo sapiens
ggctctgactaaagaatatgacagatcagatattcctctccacctgctcccctcccccatccctttttagagggctggggaaattttagtttttaatcaaaggctttatttctccagttgtgcaaaggaatttaactgggactttacaactgaataaagtatttctcagagtcgatactaatcttagcaagaggatattgcctaacccaacctaaaagcagcagagtcattacagaaatattatgttggccttgatttctaccccaccatgagttatgctactcaccaggtagcctgttttgtttttcatttttagagacagggtctcactctgtcacccaggttggagtgcagtgtcacaatcatagcttactatgacctcaaactcttaggctcaaatgatccacctcagcctcccaagtagctgggaccacaggtgtctgccactacacttggctaattttttaattttttgtagagataggagcttgctaagttgcccaggttggtttggaactcctggcttcaagcagtcctcccgccttgggctcccaaagtgctgaggttacaggcgtgagccactgtgcccagcatgtgccctgttttaagtgtatctcctgctgtagtccgttacatgtgcacatctcttctgtgtttactgtgtacctgctctatgctgagaagaatgtcttttcaaaac

SEQ ID NO: 1377 - DNA, 700 bp, Homo sapiens
cccaggttggtttggaactcctggcttcaagcagtcctcccgccttgggctcccaaagtgctgaggttacaggcgtgagccactgtgcccagcatgtgccctgttttaagtgtatctcctgctgtagtccgttacatgtgcacatctcttctgtgtttactgtgtacctgctctatgctgagaagaatgtcttttcaaaactcacaccctcccttaggagagagaggtggccacatgaatggagaatgactgcatagcatgctgagggctgtggtaaaagaggctgaatggtgagctgccaggtacggcatccttcctgtgcagctgacatggtgcctgacacatgtctgcctgaccaaaggggcagaagaggcttctcaggggaagttctgtttgaggtcttcagcagttcaacagctggggaaaggtattccaggagcgagtgagtttggatgccatgtgcgttggtggtgtgcttgaagtagagcaaacggggtggaggcaaatgagcctgaaaaggaaagagatgggacaggatcctactgtggaagagttttctgtaagcagtgggaagccacagaaggattttaagtgggccattcacattgtgttttattttgagacagggtctcactgtcacccaggctggagtacagtggcatgatcaaggctcactgaagcctcaacctcccaggctaaa

SEQ ID NO: 1378 - DNA, 700 bp, Homo sapiens
aggcaaatgagcctgaaaaggaaagagatgggacaggatcctactgtggaagagttttctgtaagcagtgggaagccacagaaggattttaagtgggccattcacattgtgttttattttgagacagggtctcactgtcacccaggctggagtacagtggcatgatcaaggctcactgaagcctcaacctcccaggctaaagcaatcctcctgcttcaacctcccaattagctgagagcacagctgtgtaaaaatttaattttttttttttttgtagagacaggatgttggccaggctggtctcgaacttttgggttcaagcgaagctcccatctcagtctcccaaagtgccgggattacaggcgtgagccactgcacctggcctatttgtgttttagaaaaacaactgctgggccgggtgtggtggctcacccctgtaatcccagcactttgggaggttgaggcaggtggatcacgaggtcaagagattgagaccatcctggccaacatggtgaaaccccgtctctactaaaaatacaaaaaaatttacctgggcgtggtggcatgcacctgtagtcccagctacttgggaggctgaggcaggagaatcacttgaatcccgggggcggagattgcagggagccgagatcgcaccactgcactccagcctagtgacagagtgaaattctgtctcagaaaa

SEQ ID NO: 1379 - DNA, 700 bp, Homo sapiens
ctggccaacatggtgaaaccccgtctctactaaaaatacaaaaaaatttacctgggcgtggtggcatgcacctgtagtcccagctacttgggaggctgaggcaggagaatcacttgaatcccgggggcggagattgcagggagccgagatcgcaccactgcactccagcctagtgacagagtgaaattctgtctcagaaaaacaaaacaaaacaaaaagaaacaactgctggagagtttgtgaaggattagagggagcaagacgggatgctggttgggatggtggttgggagagcagatgctatacacacctgtgtcccggaggtggaaagggtcatcagccagaggagtaaccgccctctcttctcagctgttttgcttgcactcgtgattggtataaactgagggagcaaatgtgtgtcctcttattcacgttgcctagtaagtacccaggtgtgcagtgagcatacaaaacatcaaaacatattttcgtttggctgaactctggctaatcagaaactagaaggaacagacagcttagagacttaaagttggactaggaagaagttgacaggatggattagaagatagccactttaggctgggtacagtggctcatgcctgtaatcccagcactttgggaggccgaggtgggtggatcacctgaggtcaggagttcaagaccagcctggccaacacag

SEQ ID NO: 1380 - DNA, 700 bp, Homo sapiens
  misc_feature (1)...(700): n = A,T,C or G
aactctggctaatcagaaactagaaggaacagacagcttagagacttaaagttggactaggaagaagttgacaggatggattagaagatagccactttaggctgggtacagtggctcatgcctgtaatcccagcactttgggaggccgaggtgggtggatcacctgaggtcaggagttcaagaccagcctggccaacacagtgaaaccccatctctactaataatacaaaaaaatgaggcaggtgtggtggcaggcacctgtaatcccagctactcaggaggctgaggcaggagaatngcttgaanctgggaggtggaggttgcagtgagccaagatcnngccantgcactcnagcctgggngncagagcgagantctgtntnannaaaaaaaaaaaaaaaaaaaaaaaaannncaacactttagagagccaaggagagggtgtctgggtacttagggcaaaagcccagttgaggaaacgctgggcgtgacagctaactggggattttagtactccacctgggaatggaactcaaacttgagctaataaattgaatctagaaatcagccccaaggctagagaaagtgcctgccttgctcctagtggaagctactagaaactgagaagccaaccctgtgtgtcataggccaggctgtgcctagctccataaggaagctctgcgttgtgcttagccttgaga

SEQ ID NO: 1381 - DNA, 700 bp, Homo sapiens
ggggattttagtactccacctgggaatggaactcaaacttgagctaataaattgaatctagaaatcagccccaaggctagagaaagtgcctgccttgctcctagtggaagctactagaaactgagaagccaaccctgtgtgtcataggccaggctgtgcctagctccataaggaagctctgcgttgtgcttagccttgagattcccatccttagataatgtgggcaccctgagattatgtgaaggagggcagagaaaaaccaagagcagggtcaatgacatggacagcaacaagcagagcccccttggcatttgtaacagaggtgaccctttgtaactgtagcccaacaatgtttccataaaagacagccatagatttgagccaaatcattttttgattcatttttccaataaataattattaccccctagatgccagttacagatagtttattcattggcaaaaggtggaggtatgatagccaggagggaaaggttcagacttactgtcaatgtcatattccacacacagacaaaaggcatgtcccatgaagcaggcacgggctgtggctgagtttgctacataaatgtgctcagatgacaagcatcttaactttcacttaatcctgaaggtttttcaccctctgttttttgttttgtttttttttttttgagacagaatctcgctctgccgcccaggc

SEQ ID NO: 1382 - DNA, 700 bp, Homo sapiens
gacttactgtcaatgtcatattccacacacagacaaaaggcatgtcccatgaagcaggcacgggctgtggctgagtttgctacataaatgtgctcagatgacaagcatcttaactttcacttaatcctgaaggtttttcaccctctgttttttgttttgtttttttttttttgagacagaatctcgctctgccgcccaggctggagtgcaatggcacgatcttggctcactgcaacctccacctcccaggttcaagcgattctcctgcctcagcctcccgagtagctggattacacgtgtgcactagcatccccagctaatttttgtatttttagtagagacggggtttcgccatgttggccaggctggtcttgaactcctgacctaaggtgatccgcctgcttcagtctcccaaagtgctggaattacaggcgtgagccactgcgcccggcctcacccactgtttttataagtatccccctcaatttgtgttctcattgtcttcggaaattcaaaggcttgttgttgttgcatgtttgcatccagagtccaggactgcctgactgggagtaaatggaaatgtgagttgcatcttgcctaatgaagcttatgtgatgacagacctgcttagagtctgcatgtgtcctttccatggcgtgctctaaatcttcctactttcctttaccatcctgtcctcata

SEQ ID NO: 1383 - DNA, 700 bp, Homo sapiens
gtcttcggaaattcaaaggcttgttgttgttgcatgtttgcatccagagtccaggactgcctgactgggagtaaatggaaatgtgagttgcatcttgcctaatgaagcttatgtgatgacagacctgcttagagtctgcatgtgtcctttccatggcgtgctctaaatcttcctactttcctttaccatcctgtcctcatatacaaactgtaacccactacccatatcctgtggcagactacaactcacattagccattgaatgcaaatgagcctcaatcaaagaagaaaggaaattaaaatttacagtatgtgtcttctccggttggcctgaggagcctccatgactctcatagctatttattgcccttggcatgctggtattttatgtgggcagggtgaaactggctgtggtcagggtgagacttgaagcttttgatttgttcccttattttgaaagggttaaaaagatgttacatgttttggtgtaattttagtactcatattaattttgtcacatctctgtaagcgaggatgaaaagagagtgctcaatcactgttactagatccatattcttacagagaacaagtcttcaaaaggcaagttttgatgacacttgggtttttttcccccttttaatttcttttaaataacagctttattgagatagaattcacctactacgaaatttatcctttta

SEQ ID NO: 1384 - DNA, 700 bp, Homo sapiens
tcatattaattttgtcacatctctgtaagcgaggatgaaaagagagtgctcaatcactgttactagatccatattcttacagagaacaagtcttcaaaaggcaagttttgatgacacttgggtttttttcccccttttaatttcttttaaataacagctttattgagatagaattcacctactacgaaatttatccttttaaagtgtacgagtcagtgctttttagtatgttcatagaattgtgcaaccatcaccattatctaatatccgaacattttcatcacccctgaaagaaaccccaccccccattatcagtcactccccatgcctccacacccgcctcccacccacagcctgtagcaatcaatattctatttttgcctctgtggattctcctgttctgaataattcatatcagtagaatcataccatatgtggtcttctgcatttggcttctttcccgtcacatactgtttccaaggttcatccgggttgtggcctctgtcagtacttcatttctttttattgacaaataatatgccattgtatggatatgccactttttgtttatccatcagttgattgacattttggttgcttctacttttttttttttttctttgagacagggtcttattctgtcgctcaggctggagtacagcagcgcagtcatagctcattgtagcctcaacctcccagg

SEQ ID NO: 1385 - DNA, 700 bp, Homo sapiens
ctctgtcagtacttcatttctttttattgacaaataatatgccattgtatggatatgccactttttgtttatccatcagttgattgacattttggttgcttctacttttttttttttttctttgagacagggtcttattctgtcgctcaggctggagtacagcagcgcagtcatagctcattgtagcctcaacctcccaggcttgagccatcctcccacctcagcctctccagtagctgggactacaggcatgtgccaccatgctcagctagttttttgtagagacagggttttgccttgttgcccaggctggtcttgaactcctggcctcaagtgatcctcctgcctcggcctcccaaagtgctgggattacaggtgtgaaccactgctcccagccacttctacttttttgctattatgaataatgttgctatgaacatttgtgtagaggtttttgtgtggacatgtgttcctagttcccttgggtatatacctaggattggaattgctggatcgtaaactattttatccttttgaggaactgccaattgttttccaaagtgactacaccatttttcaatcactccagcaatgtaggagggttccaatttttctacatcttcaccaacagttattgtcttttaaatgttatttctttaatgaaaaaacttcatttatgcacataacacacacacacaca

SEQ ID NO: 1386 - DNA, 700 bp, Homo sapiens
ttggaattgctggatcgtaaactattttatccttttgaggaactgccaattgttttccaaagtgactacaccatttttcaatcactccagcaatgtaggagggttccaatttttctacatcttcaccaacagttattgtcttttaaatgttatttctttaatgaaaaaacttcatttatgcacataacacacacacacacacacacacacacacacacacacacacacacacacacacacacacacacacacacacacacacacacagacttataatggaaagccgaaagtctccagccctgtttcacccctccttagtccaagtcccattcccagcaaaccatcttccatttttatttttagtttttccagtgactatcattataattccaaagattgcttgattcattattttttcttctctttttattatgaaaactttcaattatgtataaaaggagaatagtataaccaaccccctgtacacatccccagctgcaacaactgtcaacccatgaccacttttacccactgttttttgctttatcagtgttagatgtcatacattgatttccctattgaagaaagagaatttacctaattctatcacttccaaatttttatagtaaattatttttagttcttctattacctttgtgattttgataaatccctaaaccttgtgttcttgttccatcca

SEQ ID NO: 1387 - DNA, 700 bp, Homo sapiens
aacaactgtcaacccatgaccacttttacccactgttttttgctttatcagtgttagatgtcatacattgatttccctattgaagaaagagaatttacctaattctatcacttccaaatttttatagtaaattatttttagttcttctattacctttgtgattttgataaatccctaaaccttgtgttcttgttccatccactgtgcacagtgttatttaactgccctcttgtccatgcaagctggagatagcaatgcccacctctcttttcttctgctttcacctcccagccatttccagctatagctcttatattattcagtggatagcaatttatagtctgttctccaaccatcatcaagtcttctgtgctttgtctattggttggttctaagacttgagaatcaagagaatttacattattatgactttaaatatcgttcactgtagagccatatggtgtactgaggattacttcttttttctgtagactcagtataacaatccttgtgccaatgggggaagaacgttttagacatccagttgataccttttctgttcagaaatatatggtaatccatagcactcttggacccaaggtgtcttatttacatcttgtatggccttgtgttctttaattatcttgtgtgttatgtccctaactcgagagggaacccctcgagggggaagtggtctttc

SEQ ID NO: 1388 - DNA, 700 bp, Homo sapiens
  misc_feature (1)...(700): n = A,T,C or G
taacaatccttgtgccaatgggggaagaacgttttagacatccagttgataccttttctgttcagaaatatatggtaatccatagcactcttggacccaaggtgtcttatttacatcttgtatggccttgtgttctttaattatcttgtgtgttatgtccctaactcgagagggaacccctcgagggggaagtggtctttcctgttttgctcccatagcatttatagtctcttggtaaactaaattgatttccctaaaagttgcaaaccataatttcatttgtcaagtaaacatagccaatacattaaatgccattgctgttagattctatatatactttattttatgatgagttataaatatataaatacttaaannataaagctatcaaaaactcataaattaaaatattcagctcgaacactttgaatatttctctctcatgatcgtctttagcctttccaagaagttttccaacgtactctggttggcttccttcacaggacaggaattctgcaaaanaaacatttcattagcttgcattggtaagcatttgtcttgcctgcctgtctacttgatcaagcctactgtggcacttgtcacctgaacacttataaaaccaaggcctccagtctagcctgactgggagttgtctctatcactaggccagcaggttttgcctattttgggtgcatactac

SEQ ID NO: 1389 - DNA, 700 bp, Homo sapiens
  misc_feature (1)...(700): n = A,T,C or G
acaggacaggaattctgcaaaanaaacatttcattagcttgcattggtaagcatttgtcttgcctgcctgtctacttgatcaagcctactgtggcacttgtcacctgaacacttataaaaccaaggcctccagtctagcctgactgggagttgtctctatcactaggccagcaggttttgcctattttgggtgcatactacttacacttctagaaatggttactgtataccattacctatctgcttttggggtgggtggcgcgggggggagtgcagtctctggagaggtgtgtcacagctaggtgcttgctcagagggtggaacttgaagatgctggctcagacctgcccggtgctctactgggccttctgcatgactgcctggactgctgagagagattcagtcatgtggccctcctgtgccattaaacagcagcaccgcagcacagcagccctaaaggtgggaaggattccagatgctacccccaggccactgcttcagtttgaatctcagctctaccatttattaattgtattgcttaggatgtactacttaatttataaaagcttcagtttcttttgtaaagttgggacaattgtttgcctacttgcctgcttcataagataatggagagaattaaaagagagaacatgtgttgtgccaagttcctatcccatgacctatcccattgtctacaagg

SEQ ID NO: 1390 - DNA, 700 bp, Homo sapiens
agtttgaatctcagctctaccatttattaattgtattgcttaggatgtactacttaatttataaaagcttcagtttcttttgtaaagttgggacaattgtttgcctacttgcctgcttcataagataatggagagaattaaaagagagaacatgtgttgtgccaagttcctatcccatgacctatcccattgtctacaaggtgataggcccagagaggggatacatgtccttgttctcctctaaagccaattaattcctccactcgatattagataacatccactctgggctacaaggacttctgccccctaatgattcttcctctttctgctctcttcagttcttcctgctccactggaccattcccccaggtgcattaacatgctgggtatacccccaaccttaaaagagcttccctcactccataaccaccctgcagctgtgggtcagtttctctgcagccttatagctaaacatcttcaaagagtgttctgccctcactgttccttctttgtctcctctcgccaccctatcctcggtgagcccactccagctgggctttccttcctgcctctccatttacatcagcctcacccatggcctccatcagccaaacccaggggcctttcttggtcctcacctgacctgtcctttcagtacatttgacacagtcaaccctccctccttgagtgtcctcaa

SEQ ID NO: 1391 - DNA, 700 bp, Homo sapiens
cactgttccttctttgtctcctctcgccaccctatcctcggtgagcccactccagctgggctttccttcctgcctctccatttacatcagcctcacccatggcctccatcagccaaacccaggggcctttcttggtcctcacctgacctgtcctttcagtacatttgacacagtcaaccctccctccttgagtgtcctcaacggcttcctggggtaccgcccactctccagtgttctcctgcctcactggtcactcctcctcaggccccttggctggatcctcctctcctgacctccatgtgttgatctcaggctcagtcctttgatctctccctttctgtcattcagattttcagcagtatctatctaaggactctcctttttgtattgcaagttctgacctctcccctaagttccagacttttctaaccatcttctcaacaccttcacttggctatccaagagccaccttacatgtacgatgtacaaaattgaactcttgatcttctgctgaacctccagccctgccttgccgccagtctttcatctctctgtaaacagtactgaccatcgccagaggggtttgggcaggaacaaagaggtcatcttttcctcccctgtatcttaccccctacaaccgatctgtcagcaaatccttctggttttatttttagtcatatcccaaatctgttcacctcaa

SEQ ID NO: 1392 - DNA, 700 bp, Homo sapiens
ttgatcttctgctgaacctccagccctgccttgccgccagtctttcatctctctgtaaacagtactgaccatcgccagaggggtttgggcaggaacaaagaggtcatcttttcctcccctgtatcttaccccctacaaccgatctgtcagcaaatccttctggttttatttttagtcatatcccaaatctgttcacctcaactgctcccattctgtccacgccaccatcatctctagcctggtttactgtggtagcctcccaacaggccatcttgcttcattctgtccacgccaccatcgtctctagcctggtttactgtggtagcctcccaacaggccatcttgcttcattctgtccacgccaccatcatctctagcctggtttactgtggtagcctcccaacaggccatcttgcttctatgctttccccctttcagcctatttaccacacagtagccagactgacccttttaaatcacgtaaatcagattgtacagtctttgtcctgcccaaagctctgcaggtgttccctgccatactcgtggtggaatctaaaggccttgtgtgatctgctgtcctggaaactacccctcactcactctgatccagccacactggccttcctactggtctttaaatacaggaagttagttcatttccatcctaaggcctttgcatacctcctccttctgcctggaa

SEQ ID NO: 1393 - DNA, 700 bp, Homo sapiens
ctttgtcctgcccaaagctctgcaggtgttccctgccatactcgtggtggaatctaaaggccttgtgtgatctgctgtcctggaaactacccctcactcactctgatccagccacactggccttcctactggtctttaaatacaggaagttagttcatttccatcctaaggcctttgcatacctcctccttctgcctggaatggtctccctagttagtcatgtggcctgctccctcaattcaaatatctgctcagataatgtcaccagctcctaagtcagccccctcccccatgactcttatgttctttatttctatgtttttctttgtagcacgtatcactgctggccatcattttacatgtttgtttttctaactctcccattagaacattccatgagaacagggactcggcctgcgtgtctttagtgacacgtcctcagcacctagaaccacacccagcacttgtggaacttcagcaaatacttattgaatgagtgaatgaatgaatgggttgaccaagggtgctgcagctcccaaggagtgtttagaagtgaggctgctgtccaccaggagccacgcggccggcttgccaggaatacagtgcagcttaccaagcccgccaggccccagaggttcctgtcgagccgtttcaggaatcggatcagctgcttgtgcctgtggaactgctgtgcagtcgc

SEQ ID NO: 1394 - DNA, 700 bp, Homo sapiens
aatgaatgaatgggttgaccaagggtgctgcagctcccaaggagtgtttagaagtgaggctgctgtccaccaggagccacgcggccggcttgccaggaatacagtgcagcttaccaagcccgccaggccccagaggttcctgtcgagccgtttcaggaatcggatcagctgcttgtgcctgtggaactgctgtgcagtcgcacccaggcagcgagtgtccttctcatggtggctgtagaactgccggagcacagtcgcagccctgcagaaggtttccttctcagttgtgttctggaaagacaaatgccacagatagcaatgtgccagctccatttggaggatgggagagagatttttcctcttgatttcttctttccaggaggacaaatggaggtgagtttgctcaactacagacctgtcttcaagtattccactgaaggaaggctgcttgccacagacataaacctctgtcaacaacctctcccaattgcaaacgcagcagccttctccccagaacctcccagtttcctttctcttggaggattttgccgaaagggtacctgaataaagtcatcccatgaggaaaaggcacagtggggactagaatgcaggaccatctgtcgctacagcccacgttctgcgtccgtgtctctatacctcatgagctattctgctatgaaaagtgcccacatgagctctc

SEQ ID NO: 1395 - DNA, 700 bp, Homo sapiens
cagccttctccccagaacctcccagtttcctttctcttggaggattttgccgaaagggtacctgaataaagtcatcccatgaggaaaaggcacagtggggactagaatgcaggaccatctgtcgctacagcccacgttctgcgtccgtgtctctatacctcatgagctattctgctatgaaaagtgcccacatgagctctcagtcaggttctgctcttgttcccagaggttttaaaatccagctttccctggaaatcctgcatgcctgttgaataaatgagtgcacatcctttggcctgaactctgctgctttggccagcactctccgtgtggctctccccatgggagaggagagcagcacatggcccaagtgaggagctaagacattttgccaggcagcaagagataagtgcacagatcagggaaaggtgtcctgggagatcagaggaggctctgggagcaggtgccattgatctgagccttgggcagagcttctgtaaggggccttttggccccaaatgatgcggagtgagaatctccttggaatgccagcaactgtgagggtctggccacatggctcttcctgggggcccttagccttagagaagggaatggacaagagacaagtcattgggaacccaggagagggattgtgtctcagtctgaacctggcctggtgtgtcctctcatttttcactga

SEQ ID NO: 1396 - DNA, 700 bp, Homo sapiens
aggggccttttggccccaaatgatgcggagtgagaatctccttggaatgccagcaactgtgagggtctggccacatggctcttcctgggggcccttagccttagagaagggaatggacaagagacaagtcattgggaacccaggagagggattgtgtctcagtctgaacctggcctggtgtgtcctctcatttttcactgaagaacaaagatgcagaacctggagagggttcttagcttgagcccagttcctttatccagttcagataaagaaagctatccccagcctctcccccgacatgctctggtcccttgatactcaaagtgtggtccatggaccagcagcatggacatcactgggagcttcttagaaatacagaatctcagaccacccctgccccacccagaccctctgaatcagaagaacagtgacaagatgctcaggggtttctatcagcagcgctgtccaagcagctttcaagttcttacatatttttttttctgatgatcaagataacatatatttactataaaggtaacatatattcaacaaaaatacattcactcatcccaccagccagaggtaactattgctgttaatattttggtaaatatcgtcacacttttaaaaatactttttaaaataggggtcaactgttgatactgttttgtaacttctttactctttacatataccataa

SEQ ID NO: 1397 - DNA, 700 bp, Homo sapiens
tctgatgatcaagataacatatatttactataaaggtaacatatattcaacaaaaatacattcactcatcccaccagccagaggtaactattgctgttaatattttggtaaatatcgtcacacttttaaaaatactttttaaaataggggtcaactgttgatactgttttgtaacttctttactctttacatataccataagcatttcctaagcccttcggtggtattagagaacatgggattgagagctgcgtagaaacgcattgcacagtggtactgtcatttgtcaggcccctatcgtggcagatttttgcttctgtaaataagcggcagtgagtaaactatagaaatctttgtgttcatctcttatttatgtaggctaaattctaggaatgcagttcatattttaacgttttttcaggaaagtctagacccagactgaggcaccagaatcccaggctacagaagcttcccctttcccctgtggggcgtgatgtcccatgggcagagcggttagaaagacatttacttaatgaactgactgagagtcactcctcgttcctgattctagttggaaatgtaagagtgtgtcagtatctttgggctctgggggccaagaaacagacctctctgggctttgtaggcgagtcgaggtggaagggacacgggctgatggggggcggcagatggtgcctgtgtg

SEQ ID NO: 1398 - DNA, 700 bp, Homo sapiens
catgggcagagcggttagaaagacatttacttaatgaactgactgagagtcactcctcgttcctgattctagttggaaatgtaagagtgtgtcagtatctttgggctctgggggccaagaaacagacctctctgggctttgtaggcgagtcgaggtggaagggacacgggctgatggggggcggcagatggtgcctgtgtgtctggaggtgggcagacatgcatgctgctgcagagggaacagtgagattcaagaaaaccaaaaagtcagccctttgcttcttttaccacaaaccttggtgagatttttctgaaacgctggcttggagcctggaaattaaacttaattttgacccgtatatggccacatagtataggaaaaaaccctctaaagatatttttgaaaggactttctaaaggaaacaaggataaaataagaattgaaaagagtctgcattaaatggaaaaactttaaaagaatgcatcctaagggcagctttagtgcaaggccttaacgttttagttgctctggtatcgcagcgagggggcgacactccatccctgccgtggccctggactcctaccacctgcctgtctagctctggctgctgagtgtgtctgccagtggctcagggagtgcacttggacagcctggctgacctcacagttcagaactgcttagggagtgactcagaaggagg

SEQ ID NO: 1399 - DNA, 700 bp, Homo sapiens
  misc_feature (1)...(700): n = A,T,C or G
agtgcaaggccttaacgttttagttgctctggtatcgcagcgagggggcgacactccatccctgccgtggccctggactcctaccacctgcctgtctagctctggctgctgagtgtgtctgccagtggctcagggagtgcacttggacagcctggctgacctcacagttcagaactgcttagggagtgactcagaaggaggcctgtccctcccgggaatgtcaggaaacagccacttgggagatttcttctgtggcagtgactctgtgagagttctaactcggttcttgaccagcctcactgaggaccatataaatccagcccgattggcactgcattcattatctcccatcctgcccaggatagtcagctagtgctgtatatgagaaactccttcaaaaaacagaggtatttgaggttcattatggaactctctgtagaattatgaactttagctctctttggtaaataggaaatngctccaactacttgtccacccaagaaacccttcatcagccagccagcttgcttcttcccactttgctgttcctcagacagccttgacttcatagacaccctgacaggtgttacctgtgaagcccaggacctagaccagtgccttctttccagcaactgccaagagtagaatgctacccaacttagagatactaaaattcttgttcccccgaagaaataaaatc

SEQ ID NO: 1400 - DNA, 700 bp, Homo sapiens
agaaacccttcatcagccagccagcttgcttcttcccactttgctgttcctcagacagccttgacttcatagacaccctgacaggtgttacctgtgaagcccaggacctagaccagtgccttctttccagcaactgccaagagtagaatgctacccaacttagagatactaaaattcttgttcccccgaagaaataaaatcaataggctggattttggaaagatgttttctttgggaacacaaagaagtaccttttcctctgcataccacctttgtaggtttttgaaaatagcaacatttcactgttctgaaatatcttaacatgtaagtaagcagtgctgaatcttcgaggggaagaaaagagtgaagagtgagatcgtgaactccaggaggatgaagttcaggggaggcaaatgagacgggtaagagtgaaggcaggcagtggggattattctaggagatgtttgtgtgtgtgagagggaggtgagtgaggactgagtgaagaggggagttaaggacgggagggcagcagtgtcctggcctgcacccgggggtcttccagaaacagcccagatggattgccccagactcggcatcctggatggtttgatcctttccaacccggtcccctccttcttagaatcatcgcttctctgcacctgttcttgcttttaatcgtggttatatcatctcacaataa

SEQ ID NO: 1401 - DNA, 700 bp, Homo sapiens
  misc_feature (1)...(700): n = A,T,C or G
tgaagaggggagttaaggacgggagggcagcagtgtcctggcctgcacccgggggtcttccagaaacagcccagatggattgccccagactcggcatcctggatggtttgatcctttccaacccggtcccctccttcttagaatcatcgcttctctgcacctgttcttgcttttaatcgtggttatatcatctcacaataacactttgcactaactcaagagctggattccaatcaaccttgcaatcaccttcagaatcactttcatatcttcacatgtggaaactgaggtgcagagaggtgtgaagatgtgctgaaggccagccacacagctagtcagtggcagagctgggtctaaaaccacaggcagtcttacctccaggccctcagccctcacccttcctccaggcctggcttctagtgaggtggcccttcccttggctttgttagagccttctcagcagtgccacaggcctccagagacccagtgctcaacccggtggactcttggcttctagtaggagccatctcggttggatggacttggagattttatacacacacacacacacacacacacacanananatacanananatanatacanacananatatananacacacananananananacacacacacacacacacacacataaactgttgcccaggtgcagtggctaatcccagcact

SEQ ID NO: 1402 - DNA, 700 bp, Homo sapiens
  misc_feature (1)...(700): n = A,T,C or G
tggactcttggcttctagtaggagccatctcggttggatggacttggagattttatacacacacacacacacacacacacacanananatacanananatanatacanacananatatananacacacananananananacacacacacacacacacacacataaactgttgcccaggtgcagtggctaatcccagcactttgagaggccgaggtggacggattgcttgagcccagaagttcgagacaagcctgggcaaaatggcaagactccatctctacaaaaaaatacaaaaattagccaggcgtggtggtgcacacctgtcgtcccggctacttgggaggctgaggtaggaagatagcttgagcctgggaggtggaggctgctatgagctgaaatcgcaccactgcactccagcctgggtgacagaacaagaccctatctcaaaaaaaaaaaaaagtgtgtatttgcccttcagaatctcatcctgtatcggactcccgggataactaatgaaatgagatagtccagctaaaggcccgaagagcagtttccctcatgaagcaggatgggccctgttctatggtctgggtgctggagtgtgaccctgcccaacacacagggcttcactcctggccatatcatctccctagtttgcatggaaagcaggtagttaggagaccactgtgaaattgaggc

SEQ ID NO: 1403 - DNA, 700 bp, Homo sapiens
tcccgggataactaatgaaatgagatagtccagctaaaggcccgaagagcagtttccctcatgaagcaggatgggccctgttctatggtctgggtgctggagtgtgaccctgcccaacacacagggcttcactcctggccatatcatctccctagtttgcatggaaagcaggtagttaggagaccactgtgaaattgaggctttggggctttcattctcagccgtgtgtttccatgaaaacaggaactgaaatgcacaaaactattgatacggctgtagtcatgtgtttgtcagagaaaatgcactatcagctgtcaaatctatctcctcccactacagatagaggggtgggggtgaggcagcacaggaggcagagaggcgaggtgcccaggcagcccgaagcagggatgtgctggacgctgcccagcaggatggttccagaccgagctggaggggagttcggccggccagagcaagctgaggagctctggacggcgagccccggaacccagagggctgttaggtggccaggctgtggaagaggaggggctctggcgataccttttctgttgccataggaagtctcttagacaaaatgaaagctccctcaacctgtcatctcaatatctgtttctgtgagagtatttggtttttcagaaatgtatgggccagaaaaattctctcattcaacaggcattta

SEQ ID NO: 1404 - DNA, 700 bp, Homo sapiens
  misc_feature (1)...(700): n = A,T,C or G
ccccggaacccagagggctgttaggtggccaggctgtggaagaggaggggctctggcgataccttttctgttgccataggaagtctcttagacaaaatgaaagctccctcaacctgtcatctcaatatctgtttctgtgagagtatttggtttttcagaaatgtatgggccagaaaaattctctcattcaacaggcatttattgagtgcctcctacgttccaggcactatgccaaagctaagtaaaacccaagagggcttttctttgaccaggatctgagtcaggactacagcatgtaagctttctattacatgtcttctaaatcaagtgaaaccagaaagaccaaaacatgcttaagagtaaagatcagacttctcgttctttgaaaacatctaacaccttagagttaatttgggcccgctcgttttccattagacaagtttcttgttcagacatttggggatggatcnccccatttgctaaaacagaccgtgggacggcttcttaccttggaggcagcaaagatgtctgttacggtcaactcggtgcacagagtcttggtccaggcagaaatgagagagcaagagacagagttaacctccaaccggacagagaagtccttgatgagcagctctcactccctccaactgaggaaacttcctacaaaccctcagaaaaaagagtggcaggggagaagcct

SEQ ID NO: 1405 - DNA, 700 bp, Homo sapiens
  misc_feature (1)...(700): n = A,T,C or G
gcttcttaccttggaggcagcaaagatgtctgttacggtcaactcggtgcacagagtcttggtccaggcagaaatgagagagcaagagacagagttaacctccaaccggacagagaagtccttgatgagcagctctcactccctccaactgaggaaacttcctacaaaccctcagaaaaaagagtggcaggggagaagcctcgctgtgtgccctggactgccaccaaccaccagttccaacttctctagcagctgttaacgttttcatgcctagaaatactgagagcatcaccagaacatctggagagatggtgccagataggtactcaccttctgctctgtgaggctgttcaaagttttgatgatctcctgtaaggtgatatcgcacttgtgtccgtggacaaagttgccggcacatgctagcaggaagaacagagggggaagcagttgggaggngagacccattaataggtgtcgatttgcagtgacaatgtgagncaattagtttatcaggagaagctaacgatncaatgctgacaaagatatctctatatatagatttaaaattgctgaaaccgagggaaaatgagtttacattggaaattttcgttacaccagattgtcagtcacttggggccaatcagcacctctcttccaggagaaaaaatgcctcacaaacaggtaaaatgttcctgtgaaa

SEQ ID NO: 1406 - DNA, 700 bp, Homo sapiens
  misc_feature (1)...(700): n = A,T,C or G
aattagtttatcaggagaagctaacgatncaatgctgacaaagatatctctatatatagatttaaaattgctgaaaccgagggaaaatgagtttacattggaaattttcgttacaccagattgtcagtcacttggggccaatcagcacctctcttccaggagaaaaaatgcctcacaaacaggtaaaatgttcctgtgaaatcagaccaataggaaaatgaaacctttttaaaaaattaactacaaagtttcagcataggaaattacaccataatttgctctttagattaatcttatcagcttggggctgctgctggctttttgctttgcatagaagggagaggccacaggtgtccgaatttgttgtaatgcagtcctcctggggaaagatagagtaatatcaagaaagttttacttgaaaagtattttaacctggcttcttccaagtacaggtggcatcttggaaactgtcctgtcatggaaaagctgatctggggctccttctctgcatagaggcagaataacaggcagactctcctaccccagcactggggnacaatgttctcccaagtttaggtgttttgagaaggacaggtcgtatcaggtgaggcctagtttgggtcccagcaggtccataaggtccttacccataaggaagcccttggcaaggtaggtctattctgaggtttcaggaatgact

SEQ ID NO: 1407 - DNA, 700 bp, Homo sapiens
  misc_feature (1)...(700): n = A,T,C or G
ccttctctgcatagaggcagaataacaggcagactctcctaccccagcactggggnacaatgttctcccaagtttaggtgttttgagaaggacaggtcgtatcaggtgaggcctagtttgggtcccagcaggtccataaggtccttacccataaggaagcccttggcaaggtaggtctattctgaggtttcaggaatgacttttttttttttttttctgagacagggtctcactctgtcacccaggctgaaatgcaatgttgtgatcagggatcactgcagcctcaacctcccaggctcaagtgatcctcccacctcagcccccctagcagtaggtgcgtgccaccgcaccatgcctggctcatttttatttttattttttgatagagataagagtctcactatgttgcctaggctcatctcaaattcctgggctcaagtgatcctcctacctcagtctcccaaagctctgagattacaggtgtgagccaccatgcctggccaggaatgcccactttttgaatggaacctaaacacatcctcagctaattaggaaaaagagctacagtcttaccaacttacaaatcagccctcctagtcagtgccccaccacccgccctgcttgttttttattgaattcatgtggacacaataaggtgctcattgcctcaccccagcagtgaacgtaaggaccccaccac

SEQ ID NO: 1408 - DNA, 700 bp, Homo sapiens
gccaggaatgcccactttttgaatggaacctaaacacatcctcagctaattaggaaaaagagctacagtcttaccaacttacaaatcagccctcctagtcagtgccccaccacccgccctgcttgttttttattgaattcatgtggacacaataaggtgctcattgcctcaccccagcagtgaacgtaaggaccccaccactcactcaggtgcctgggccctgtgcaaggccaccccacctcccagtaagggctcatgggcagcaggattcttgggccctgcctgccccctgcttttctcccagaaccttcccttcccttggtctctgaccttcttttccctatgaatttcttttttttttttttttttttgagatggaatcttgctctgtcacccaggctggagtgcagtggcgtgatcttagttcactgcaagctccgcctcctgggttcatgccgttctcctgcctcagcctccccgagtagctgggactacaggcacctgccaccacgcccggctaattttttgtatttttagtagagacggggtttcaccgtgttagccaggatggtctccatctcctgacctcgtgatccgcctgcctcggcctcccaaagtgctgggattacaggcgtgagccactgtgcctgggcctccctatgaatttattctggaagatcatctaaaaatgtgtgttgct

SEQ ID NO: 1409 - DNA, 700 bp, Homo sapiens
acctgccaccacgcccggctaattttttgtatttttagtagagacggggtttcaccgtgttagccaggatggtctccatctcctgacctcgtgatccgcctgcctcggcctcccaaagtgctgggattacaggcgtgagccactgtgcctgggcctccctatgaatttattctggaagatcatctaaaaatgtgtgttgctaaggttttgcctctgttccacttccccgcccccccctcaccaccccctgcccccatactctgtcacccaggctggagtgcagtggtgatcatagcttactgtagccttgatctcctgggctcaaggcattctccagcctcagcttcccgagtagctgggattacaggcacatgccaccacgcctggctaatttctgtattttttttttttttttagtagagatggggtttcaccatgttggctaggctggtgtcgaactcctggcctcaaaatgatccacccacctcagcctcccaaagtgctgggattataggcgtgaaccaccatgcccggccaaggttttgcctctgttttggatcttttcttcccttattattattattattaaattgacaaataagtattgcacatatttgtgctgtatgatataatgttttgaaatgtgcatgttatggaattgctacatcaagctacttatacaatacttcacatatttatt

SEQ ID NO: 1410 - DNA, 700 bp, Homo sapiens
gtgctgggattataggcgtgaaccaccatgcccggccaaggttttgcctctgttttggatcttttcttcccttattattattattattaaattgacaaataagtattgcacatatttgtgctgtatgatataatgttttgaaatgtgcatgttatggaattgctacatcaagctacttatacaatacttcacatatttatttttggtaagaacatttaaaatctactctgtgatttatttatttattttgagatagagtcttgctctgttgcccagactggagtgcaatggcgcagtctcagctcactgcaacctctgcctcctgagctcaagcaattctcctgcctcagcctcccgagtagctgggattacaggtgcctgccaccacgcccagctaatttttgtatttttaatagagacagggttttaccatgttggccaggctggtctcgaactcctgacctcaggtgatctacccacctcagcccctgcaaagtgctgggattacaggtgtgagccactgcgcctggcctgtcttcatgatttttaagtatacaagacattgatatcaactgttgtcaccatgtcgtacaatggctctctttaacttaactcctcccagttgaaattttatatcctttgaccaacatcttcctgatcaccaccctcccagcccctggtgaccatcatcctactctct

SEQ ID NO: 1411 - DNA, 700 bp, Homo sapiens
tgggattacaggtgtgagccactgcgcctggcctgtcttcatgatttttaagtatacaagacattgatatcaactgttgtcaccatgtcgtacaatggctctctttaacttaactcctcccagttgaaattttatatcctttgaccaacatcttcctgatcaccaccctcccagcccctggtgaccatcatcctactctctgcctccctgagtttggcttttttatatttcacatatgcgtgagatcatgtggtatttgtctgtctgtgcctggattttttcacttagcataatgtcctccaggttcatccatgttgtggtgaatgacagcgtttccttcttttttaaggctgtatagtattccactgtctatatatagttttggatcttatcgcagtgcctcaagttctgtgaaggagagaatctggataattgtatcaggaggtccttagaccatatttaggatccttccattgggactgggcagcaaggttaccaaactaaatgcagtggcttcagatgccaaaccacctgagatgagccacacctcacaggtgaggggtatggtcccccacaacactgcccttgcttcagacgccagctgcacattcaggggttcccagcccaccctcactgctgactggctgcaaatctgggagtttccactacccctcaggttccagaatgcactaggatgact

SEQ ID NO: 1412 - DNA, 700 bp, Homo sapiens
actaaatgcagtggcttcagatgccaaaccacctgagatgagccacacctcacaggtgaggggtatggtcccccacaacactgcccttgcttcagacgccagctgcacattcaggggttcccagcccaccctcactgctgactggctgcaaatctgggagtttccactacccctcaggttccagaatgcactaggatgactgacagaactcaggagagtgctatacgtaaggccacagttttatcataacaaaagcattcaaatcagaaccagccaaaagaggagacacaggggcgagatggaggaggggcccaaacacaaagctctcattgtcttccccgtgtggcgtcagaggcatcaccttctcagcactttgacgtgtgacaaaatgctgactatttctaagcagggaggctcacttgagctttggggtccagagtttttatttgagtcttatcatataggtgtggttgatggactcattggccactgggttgaactcatcttcctggtctccttccgggaggccaggctgatatcacagaacctcagtggcgtggccagcccctccatggtcgtattgtcagcaaaaactacctagggcccaccatgagtcacttcactcgcataaactctcagagaccaccatgaataataagatactcctatcacttgggaaatccctaggaatttggggcta

SEQ ID NO: 1413 - DNA, 700 bp, Homo sapiens
ctcatcttcctggtctccttccgggaggccaggctgatatcacagaacctcagtggcgtggccagcccctccatggtcgtattgtcagcaaaaactacctagggcccaccatgagtcacttcactcgcataaactctcagagaccaccatgaataataagatactcctatcacttgggaaatccctaggaatttggggctacctcctgggaactggtgacaaggactagccacgttgtttactccaagggtttgtagctggtaggacctcccaagagccaggacaaaggccagacttcttggataaaggttgattcttcactgcacaaactggaggagagttatgagaagagcaggtggttgcttccaaagcaggtggggactttggatccgatgaactattatgtggaatgaagtacagcagcggttccagttaacacaggagggagctcatcaagctgcggacttgctgggtggagagcttctgccaaataggttctcaaggagagtcggggatgcagaaggggagctggtggggagggcggggttctggggcgtctgtgggggcagtggaacagccatttatgtgtccatctggtgtttttctaagcacccactaaagggcagaccctgggcttgaggctctgagggcagagctggtgagtgaaaagggaatattaggtgggcaccttcagctcaga

SEQ ID NO: 1414 - DNA, 700 bp, Homo sapiens
caaggagagtcggggatgcagaaggggagctggtggggagggcggggttctggggcgtctgtgggggcagtggaacagccatttatgtgtccatctggtgtttttctaagcacccactaaagggcagaccctgggcttgaggctctgagggcagagctggtgagtgaaaagggaatattaggtgggcaccttcagctcagaagcagaatccagcttgttttgtttgtttcaatggtgaaatgaggccaaagatgaaaggataaactgtccagaacattcgagagtgaccaggagtctccccagagggcagaagtgggggatgggccatcctcgcctgcagggacagcaccatggcagctgcaggtgcggcaggtgggtagagatggggaaggtgggtgcctgcattgtcagggacaaagaggagggcagtgatcaccaccactaccaccactgcgaaggagtctccgagcctgcagggccatgggcagtgccttggcggggtgtggtgggcctgacaccaaagttcaggagggaggttgaatactgctgtctctggctgtgtcggtcacaggccccttcccctcccctgtgtgagagctgagaaccagcgccggcccctccatggatgcagagtttttccttcaggccctggaacgtagcagttatgagcactgcgtttgggagtccagcaaatgagccc

SEQ ID NO: 1415 - DNA, 700 bp, Homo sapiens
ggtgtggtgggcctgacaccaaagttcaggagggaggttgaatactgctgtctctggctgtgtcggtcacaggccccttcccctcccctgtgtgagagctgagaaccagcgccggcccctccatggatgcagagtttttccttcaggccctggaacgtagcagttatgagcactgcgtttgggagtccagcaaatgagcccttatcaactctgtgaccatgagtagatcattaactctctctgggtctcgattttctcacctgtgaaatgggaataatgtggctcttccttgtgaggagcaagtgagtggttccatggaaagtacttggcatgtgtcatccagaaagggggtctgttaacagaggctgctatagtacacggtggctaagagagcggacgctgggcccaggtggtctgtcaggcctggctgctgtgcctcctggctgtgtgaccttgggcacgctactcagcctcatctgtgaaataggggtcatagctgtccctgtctcatgaagttgctctgaggaatgaatacatttaaagttttcaagtatttagaatagtgcctggcacacagtgagtgtgatgatgataatgatgactcctatcttgagttgctgaaatgactgatgcttcatctattaggcaagcccaagtctggacagggcagtggagatctggccagacgggccctccccac

SEQ ID NO: 1416 - DNA, 700 bp, Homo sapiens
tccctgtctcatgaagttgctctgaggaatgaatacatttaaagttttcaagtatttagaatagtgcctggcacacagtgagtgtgatgatgataatgatgactcctatcttgagttgctgaaatgactgatgcttcatctattaggcaagcccaagtctggacagggcagtggagatctggccagacgggccctccccacaggttcctcctggatgtgcctcctccgtctttgagttgccgtccttgtttctggtgggtcacggtctccacactgcagcccgcctactttagtatctggattcattacagggaacagacacagctgtgggtgctttagtcaggaaaggatttcatgcaggaaagtaggtgcttctaagaatgtcaggagggctggaggggcaggctccaggctgggcccagaaccctaaagacctgacccactcagcgagccacccctgaggctgcagtgccgggattccaaagctgctgcctctgctgaccccctacactgtgagtctgctccaggagactcccggtctgacttccacaccatgagtctgctcaaggacacccctagtctgaatgaccaggtacatggtatctgccgccctcccctccacagcttgtcagccttcatctaattggaaaagccagatgctcgcttcaaaggagtcagaaacgcggcagtcaactaggag

SEQ ID NO: 1417 - DNA, 700 bp, Homo sapiens
gaccccctacactgtgagtctgctccaggagactcccggtctgacttccacaccatgagtctgctcaaggacacccctagtctgaatgaccaggtacatggtatctgccgccctcccctccacagcttgtcagccttcatctaattggaaaagccagatgctcgcttcaaaggagtcagaaacgcggcagtcaactaggagaaaggaatacaggtcgcacaatgcagcccagtctccacgggcctcgttcattgatgcttgctgtcccagccattcctgtggtccgagtcgggtgaatctcacctccctcctcttctgtcagtcctgcaggccagcacccaggagagtgctttccaacccccacaggcttagtcatggaaaaaggtgagacttctctgagggaggggcacttaagcagagttagggatgagccggctttagccaggagcaggggctgcagggtggggtgagtgcgggcaagggacagcaggtggaaggccccgaggtcactgaagagagggctcccaggaggggagcacgggccgaggggacccagccagagcattgcaggcgcccgtgacagaggcagctggcgcgaatcgggtgggatggtggcagggagagctgtgggctcttgagtcatttggcccagcacagtgtctaggttaagacctggtgtcttggtgcccacgggacctga

SEQ ID NO: 1418 - DNA, 700 bp, Homo sapiens
  misc_feature (1)...(700): n = A,T,C or G
cccgaggtcactgaagagagggctcccaggaggggagcacgggccgaggggacccagccagagcattgcaggcgcccgtgacagaggcagctggcgcgaatcgggtgggatggtggcagggagagctgtgggctcttgagtcatttggcccagcacagtgtctaggttaagacctggtgtcttggtgcccacgggacctgactggttctgaatcccagctctgggtgaccttggaaaagttcccccatccaggcttctctgtaaaactgggctgattacaggggcgagggaatactatagaaggtgacaaatatgaagtgtttggtgtggtgaccggcatattgcaagcccccggaaaatgccagcaatcaccatcaccaccaccatcatcattaatagcacttggaagtgactgaatgtgggggtgagggagagcaggaagtcgcaggtggccccaggtctctggcttggggaggaggcaggggagagggcaggcggcgggtggnagccaccagctgaggggctgctacgggccatactctgagaacaggggagggtccagcctgcaggcagtagacatggagggtgactaagccaaggggaagaacacagtgttgctggaaaaaggggtcccgattcagaccccgagagagttcttggatctcgcacgggaaggaattcaaggtgagtcgtggtgtgt

SEQ ID NO: 1419 - DNA, 700 bp, Homo sapiens
  misc_feature (1)...(700): n = A,T,C or G
gggtggnagccaccagctgaggggctgctacgggccatactctgagaacaggggagggtccagcctgcaggcagtagacatggagggtgactaagccaaggggaagaacacagtgttgctggaaaaaggggtcccgattcagaccccgagagagttcttggatctcgcacgggaaggaattcaaggtgagtcgtggtgtgtggtaaagaaaggatgtagaaaactactcagagtagggtgtcctcagaaagcatgagcaggaacgccttgtctgcttaaagcttttcttatataggggtcttgtctatacaaaagccaagctacattatgtctatgtgcaggtgggctgacagtgtcacaaaatttagtactttgttgatttaaataatgttttatccttggccttttagtgagtaagtacatcaaagcattactgtaaatagcttgaaagcatatattgttatgagacatcaggacacccagacattctgctgttgtaggagtttgtccttgcgggcgtgactaaactgcttccttggcgtaaacatctcatgaccatgggtagtgactggcaaggaatatgcctagctagttttaagatggagttgattttaaaatggtgtcaccctggctctcctccactcctgttgacctaacaatatggccaaggggtgagagaagacaggggacaagaaatgag

SEQ ID NO: 1420 - DNA, 700 bp, Homo sapiens
ggagtttgtccttgcgggcgtgactaaactgcttccttggcgtaaacatctcatgaccatgggtagtgactggcaaggaatatgcctagctagttttaagatggagttgattttaaaatggtgtcaccctggctctcctccactcctgttgacctaacaatatggccaaggggtgagagaagacaggggacaagaaatgagccagggcactcctgcgacactggaaggtggtgaggcagggtgcagagtccaggcatgagagaggcccagggaggaggagcagtggtcagcggcagcaatgttcctcgtaggtgaggctagataagggcagacatgcgttgctgcacggagtggagttgataatcagtgacctcatgagatatctgagtgcagttgggggcacaggaagtggccagatgaggtggaactcagtatgggcatctgggagggcagctgtgttgggctgcaggctgcgtcgtaggttgtcagctgtgttctgaatgggacacaatcaagcacaggctgccccagctcagcgagcggcagcttcatccttgcagttgttcacacacaacacgggaagacctcacacgctcatatccaagccaccccaaagcctctcctttcactgatgtgacatctcggattggtggtggtggggaaggggcgggggtagagatggaacaaaattgacaaaact

SEQ ID NO: 1421 - DNA, 700 bp, Homo sapiens
  misc_feature (1)...(700): n = A,T,C or G
aatgggacacaatcaagcacaggctgccccagctcagcgagcggcagcttcatccttgcagttgttcacacacaacacgggaagacctcacacgctcatatccaagccaccccaaagcctctcctttcactgatgtgacatctcggattggtggtggtggggaaggggcgggggtagagatggaacaaaattgacaaaactggccatgagttgctcattgttgacgctgggcaatggatgcttgggagtgactttcgtgtatatttgaaattttctgtaatagaagattttaaaattgtaattgcatagcaaatgtaaatattaacatatatgcacatttatatattatatatttanatctatactttatggattatataatatactatttaagtaaataatgtatacgatagcagtataatgtatacatgcatcttacacacacgcccctctccagtcctccactaccacaagcaccatcgctccccaccagcatctctgcaggcaccttggcgctcatctccctgctccgccttcgccctgcgttgcgttctccacacagcagccacggtgactttgttaaaatgtgagtcagaccacatcactccattccacttagaatgaagcccggtcctggcctctgaggccctgctgggntcctgctgcccttgccgtggcctctgctccagcccgagggcca

SEQ ID NO: 1422 - DNA, 700 bp, Homo sapiens
  misc_feature (1)...(700): n = A,T,C or G
tgcaggcaccttggcgctcatctccctgctccgccttcgccctgcgttgcgttctccacacagcagccacggtgactttgttaaaatgtgagtcagaccacatcactccattccacttagaatgaagcccggtcctggcctctgaggccctgctgggntcctgctgcccttgccgtggcctctgctccagcccgagggccacccgtgagtgctgggaagggcatccccagctcgctcttgctcaagaccttagcacctgcagttccctttcccttgatgactttgccccgatctgtgcatgggngtcccctnccccttgtttcgtcccgatctctgttcccatcttatctcatggggaggatttctccaacctcctcgcataacacagcactctccctgctgtgcagccccggactgttctatttcccacggtagcggctaccaccgcccgacacactgagtgttctctcgttggcttattctgtctccctgctagaagcaaccttgttttgtttagtggacccccagcacctagagcagggtctggcacccaggcaaggcctcaatccatacttgttgaatgaatgagtggagctccatttccacggagccactgagacgtggctgaagtaacaacactagaagtcagggacacagctggggcttgaagctgggactagtttcaccctgagcccccggc

SEQ ID NO: 1423 - DNA, 700 bp, Homo sapiens
  misc_feature (1)...(700): n = A,T,C or G
caaccttgttttgtttagtggacccccagcacctagagcagggtctggcacccaggcaaggcctcaatccatacttgttgaatgaatgagtggagctccatttccacggagccactgagacgtggctgaagtaacaacactagaagtcagggacacagctggggcttgaagctgggactagtttcaccctgagcccccggctatatgctctgcctgtgttcctgagaggggaggggatggggcccagagcacanacacatggagggccccatccaagggcacagggaccgaggggaggagagaaacgaggctggcaggcagtggcatagactccgctttgcggagctgtggggaagtagctctgcaggctgttggcttctcttgcctttcagaagcaggtggaaggtccttctcccaagagaggcagagctgctgaggagtctgcaggaatgctccatctgtccccatagtgttaatgtcacttcagcctcagagctagatgggcggcctaccctttcccttcccactcccgctggctcctgtgccctggcaggccagggcctagtgaagacccccaagaaggcagcaccttcctctgtctttggcaatgtgggatctgatgggtccaagagtgcccaacccatgggaggagcggtgctagtcctgtctggctgaggggctgccttgcaggcccctgcag

SEQ ID NO: 1424 - DNA, 700 bp, Homo sapiens
  misc_feature (1)...(700): n = A,T,C or G
atgggcggcctaccctttcccttcccactcccgctggctcctgtgccctggcaggccagggcctagtgaagacccccaagaaggcagcaccttcctctgtctttggcaatgtgggatctgatgggtccaagagtgcccaacccatgggaggagcggtgctagtcctgtctggctgaggggctgccttgcaggcccctgcagacccccacctcctctcccgagagggccggctccccagggaggacttaggctggtctgaggggtgctggtgctggtccagccgggggatgctgcaaccaggtctcctcactggcctgtctcggtccacatcctccatggagcagacatcacgttcatgttctttttgctttttaaaaatgaaatttatccttgtctcccattggaaaatgaatgcatgctcattatagaaaatgtgggaaacagatcagaagaaagaagagtaaataaaaattgccttttccaatgtggcatcaccacagctcctctggcacagggccctgggctgggcagggagttgtggactgtgtngccaacaggccatcgggctgtgggtctacaggggatgccatcggtggcttgggccttcctcccttgagggtttggggaaatggtgtccagcccccgcacagttgtccacagtgatgcagagagtggagctgacgagagttgctatatttaa

SEQ ID NO: 1425 - DNA, 700 bp, Homo sapiens
  misc_feature (1)...(700): n = A,T,C or G
gctcctctggcacagggccctgggctgggcagggagttgtggactgtgtngccaacaggccatcgggctgtgggtctacaggggatgccatcggtggcttgggccttcctcccttgagggtttggggaaatggtgtccagcccccgcacagttgtccacagtgatgcagagagtggagctgacgagagttgctatatttaattttggtgcctgcgtcacctctgaccacacagcagcgtctgcccaggcaggcagcacatggctgggggtgtttctgaacgacgctgtgagagaatcactttccccaagaaaaggtatagcagaggggaagggagagacagcaacagaaagtgaggtcgtaagtagaaaattgcttctgggatttcaaatggctttgtcatggggccctcccttnctgccgagaaatcagttgatctgggaaagtttgttgcaaacccttgccctcttgcttttgggtggagctgagaaatgaatgaagataatggggctttatgagtgtgggggagggtagctgaggagacagccaccagtcctgaccccagcttggacccctagaaaggccagataggagctggccagtgtgtccctggccaggctgtcctgtctggaacatagtcagcctgnccccagccggaccttcttagaagggaggcaggcgaagtgggaaacaggtttggag

SEQ ID NO: 1426 - DNA, 700 bp, Homo sapiens
  misc_feature (1)...(700): n = A,T,C or G
ataatggggctttatgagtgtgggggagggtagctgaggagacagccaccagtcctgaccccagcttggacccctagaaaggccagataggagctggccagtgtgtccctggccaggctgtcctgtctggaacatagtcagcctgnccccagccggaccttcttagaagggaggcaggcgaagtgggaaacaggtttggagtgtgttacaatgcaccagctagatgaagggcataggcagaagacatttctctttgaccctaatgaaaaagcgataagccgctgggccaggtgaaggccaggcttcaagctgctgcctcggtcacaaggaaataagatgcgggcctggtccccttggggcctgctccttctcgtcctgcgcaggacagggggccagcctcggagaaacctgccaagtgactgggagcattttctgacacctcatctgagcagcaaactgaggtgtttggtgccgagttcaccggaaactcgcgtgtgtctcacttctcactcaagcccagcctctcttccagtgaaacctcctgggctggggttcccgaggtgccaaggggctccccgccctgggccccatggccagcatcttcctcccactcaccaagcactcttctcccttctcaacccccttctctctgagtcctgctgagggcttgccttgtttatgaaagaacttaggccacgtg

SEQ ID NO: 1427 - DNA, 700 bp, Homo sapiens
tcacttctcactcaagcccagcctctcttccagtgaaacctcctgggctggggttcccgaggtgccaaggggctccccgccctgggccccatggccagcatcttcctcccactcaccaagcactcttctcccttctcaacccccttctctctgagtcctgctgagggcttgccttgtttatgaaagaacttaggccacgtggttagagaaaactcccagcaaacaccaccagggctcagtccccagggagggaggttcccagccacagttgcagtgctgacacttacctaccttgttctgtcttcctttctcattcctgacagggccccttccctgtcgccaccagctgcagcttggttctgtggctcagtaaggtgtcactcatccctggagagccccacgccctctccagcccagggcacactgccagtgaccacaggtcccccttcctggggagcagcctggaaggtgtgagggacaggagctcggcggtggctgaggaagtggcgagctgcagacccctagtggggcccgggacggccatccgcactgtgcacctgcctcgcaggctgtcctgaatgtgtggctcagagcacggccttggaggatcccgaggaaccttgccccacatcagcctcaattccagtctttgttcttgagggagtcacgtggaatttcactggaagggtttccatctttc

SEQ ID NO: 1428 - DNA, 701 bp, Homo sapiens
ggaagtggcgagctgcagacccctagtggggcccgggacggccatccgcactgtgcacctgcctcgcaggctgtcctgaatgtgtggctcagagcacggccttggaggatcccgaggaaccttgccccacatcagcctcaattccagtctttgttcttgagggagtcacgtggaatttcactggaagggtttccatctttctggataggcagggcaatactttggctgggcagagaggacatgggtcaaagatgatgctactgggagatagatttctaggtcttgtttacaaagtcattaccctccgtaaatatccttccagccttaaaccctaggctctggatggagaagaatgccgagaccctgactcccacccacctcccctggcttccaagactctctcgtcctttgcggaagcagccactgctcacctccagaggggaggccctcccgagggaggacatacagctcccccaacccgaccctctgttgtttctacagagttctttcaggggctaaatcttgagtgcatgtggtgtcttggttgtcactagcccaggtgtctgctgtggggtggtcccccgcaggtatttcctcagcaaacgtggcaggacttaataggcttggcaccagagagccggtcctgtctcctgcccgggacagcctgctggagacccagctcttgcaccatcaccctcttv

SEQ ID NO: 1429 - DNA, 700 bp, Homo sapiens
  misc_feature (1)...(700): n = A,T,C or G
agagttctttcaggggctaaatcttgagtgcatgtggtgtcttggttgtcactagcccaggtgtctgctgtggggtggtcccccgcaggtatttcctcagcaaacgtggcaggacttaataggcttggcaccagagagccggtcctgtctcctgcccgggacagcctgctggagacccagctcttgcaccatcaccctcttcacccccacagtcttctctcctctaggccaagtgtcccctgccccctgcactgtcaggtttgccttcttccgtcgcctctccctggggaaagtgagtggttctggagtagctggccaccatcatcagccccctggcgaactccctgccacgtcctctgctgttgcgtgaatgacacagccatgagcagtcgagggcggctgncttcagggacttctgagcatcactgtggtgttcccatagggctctgggctccccagggagggcacctgcctgtcactacaagtttgagactggttcttgaagaccatcacccactgcaaaggcatcccatcctggagtcaccctctgccctgggcacctcccagagagtcacagtgaaaagtgttgctgacgggcatggcctggagctgtggcttggtaaggcccgctggtctctgcactccagctgctgaccagggccatggggaagcaacaagagctgctgaggagtggcctagc

SEQ ID NO: 1430 - DNA, 700 bp, Homo sapiens
  misc_feature (1)...(700): n = A,T,C or G
ttgaagaccatcacccactgcaaaggcatcccatcctggagtcaccctctgccctgggcacctcccagagagtcacagtgaaaagtgttgctgacgggcatggcctggagctgtggcttggtaaggcccgctggtctctgcactccagctgctgaccagggccatggggaagcaacaagagctgctgaggagtggcctagccagagccctgttcacagaggtggtgcgtgtgtgcaccctaatggcgagagctgtccagaaatgcaatgggctgcccctcaaatataggtagggacctgcctgtcagtgagagggcccgaacaggttgatgacagttgtacagggggaaaaactccattcaggacaggtgacatttgganagaaataggnagggtggttaagtgtgtgggctttggagttaaagtgaattttggaccccaatcccaactttgctcctttacctcagatgaggctctgaggccccaggaccccagtgaggaagtagctacgtgaccttaggcaaaccgcccacgctttctgagcctcacagttctcatcggcctcctgggttgtgagggagacatggatgtgtgggtggtgccagacacagctggccagtcctcaggagatgtgattgtgagacttcctgggtctccgtctgctcctgatgccctccttgaaccctgacagtctggcccaa

SEQ ID NO: 1431 - DNA, 700 bp, Homo sapiens
  misc_feature (1)...(700): n = A,T,C or G
aagtagctacgtgaccttaggcaaaccgcccacgctttctgagcctcacagttctcatcggcctcctgggttgtgagggagacatggatgtgtgggtggtgccagacacagctggccagtcctcaggagatgtgattgtgagacttcctgggtctccgtctgctcctgatgccctccttgaaccctgacagtctggcccaagcctctccgtccttgctggtgcagcagacagaaggtggggcttccttcaggccatgtccccaccctcgggagctagcttgcattcagcccaggtcactgcaccctaccctcgctgtaatccatcccagtcccctcctccaacccaccagcctcccgaagagctcctcagagtcttcagaccacagaccagtgtccccaaaggccaaaatgaaagacaaatacaatcaggcctatctgtcaccaactttatttctggcttcagtttgatagtcaatgaaacaacttgttcaatgtcccctcccccagtgttcaaggtacccttctatatattaactctttgctaacatatttaatatttaaatacnaggaaaaacaataaattactcgttggctgagagctggctgctggctggcagacaggagcggctgttctgcccctctcctgaccctgcctcggatgaggctccgaggccccaggaccccagtgaggtagcagaat

SEQ ID NO: 1432 - DNA, 700 bp, Homo sapiens
  misc_feature (1)...(700): n = A,T,C or G
tcccccagtgttcaaggtacccttctatatattaactctttgctaacatatttaatatttaaatacnaggaaaaacaataaattactcgttggctgagagctggctgctggctggcagacaggagcggctgttctgcccctctcctgaccctgcctcggatgaggctccgaggccccaggaccccagtgaggtagcagaattctgtacacagtacttattaccagggactcctggngtncactgctttagtgctgnggncctgagtctctgaacccttggctccaagtgcnagcagccacagtcttccccaatccccaacggtgacaaacacactcatttaaataacacacaataataaataagaccaagaagaagtgtgcctgagctgctgtctgcctcagttgcctgtgtgtgaagtgggtccctgtcccaccacatgtctggcaaggggggcanccactgtaatgctacagtgtgctctagggcaggggaggggtgtagggacatgtcatccctgggtccaccgagctcagggccctggacagaggaggcccaccaggctgagccctgggcaaggggaaggctgaggtcggctaggctgaanacgggcagcacaggctgaggtctaagctaaggaattttacccctccctaaccctccttcccgcctacccaagacatttttgacatcagaaagaaa

SEQ ID NO: 1433 - DNA, 700 bp, Homo sapiens
  misc_feature (1)...(700): n = A,T,C or G
tagggacatgtcatccctgggtccaccgagctcagggccctggacagaggaggcccaccaggctgagccctgggcaaggggaaggctgaggtcggctaggctgaanacgggcagcacaggctgaggtctaagctaaggaattttacccctccctaaccctccttcccgcctacccaagacatttttgacatcagaaagaaaaatgaatctgcaacttcaatagtcaggtcctgtctctgcaaataatgatgctttcgaagtttcagttgaacngtccctcgcgaaaaagtttctttaaatgtaagagcaggtcctttacaaactgggccacctcgattttggtgtctcgganatgcaagctggaaaactgctgcaggacaaagaggtcagcacntgagtagaannccagaggccgggacgactcgcacaaaccaggggctttccagggactgtctcattcagtcctcacggaagtccccatgaggtgggtactgttagtacctctactgtacagatgtggaaattgaggcccaggtaggagttaggagcccttgagcccagatcctgtaaatcccgaaggccacgtccctgctgccacaatggccccacccctgggtgnacacacaccatggatattcagccagcttcccttcagcgagcccagggttggcaggagggggtgcagggtgggtgtgagagg

SEQ ID NO: 1434 - DNA, 700 bp, Homo sapiens
  misc_feature (1)...(700): n = A,T,C or G
acctctactgtacagatgtggaaattgaggcccaggtaggagttaggagcccttgagcccagatcctgtaaatcccgaaggccacgtccctgctgccacaatggccccacccctgggtgnacacacaccatggatattcagccagcttcccttcagcgagcccagggttggcaggagggggtgcagggtgggtgtgagagggtgggggatgccttaccccagctgagaccctgtgcgggcagaatccgctcagcatcctctgggtcttctcgatggcactgcagcctgacacgttgatcagggattccagggctgcacagtactgtggggaggggacaccgaggggtcaggccctgcttgggcagctgccttttgtgagtctgcaggaagatggggctgagatgcctggcgcaggtgagtctgggtggtgggcgggaaggggccagattatggcgggagggaggagancacttgaagcttgcttggaaccccagccatggaagggaggctcagagaagataagcccaaggcctggagcctctgccccatcctccctgcacccaaaggtccttaccatgccagctgtcaggttgatgctccataccatgctgccattgcagagcggancctnntgggagcaaagtgacagtgagcagagtgctggcaggggttgtgggcctgccctggcagcccaggccag

SEQ ID NO: 1435 - DNA, 700 bp, Homo sapiens
  misc_feature (1)...(700): n = A,T,C or G
gaagggaggctcagagaagataagcccaaggcctggagcctctgccccatcctccctgcacccaaaggtccttaccatgccagctgtcaggttgatgctccataccatgctgccattgcagagcggancctnntgggagcaaagtgacagtgagcagagtgctggcaggggttgtgggcctgccctggcagcccaggccaggtctgccccagcacaggncccacaagcatccctggtgtggcacagaggcaggcctggcancccctcancattcctgagcttcgttttctgctttgaacagcangcataggggtgaggtcccactgtttagggtcttggagctgagagaaaaaaattgacaccactagtaagggacaagctgcatgcaaggcttgccatagtcagggcaggaggacaggggcctgcgggaagggccagggtggggacgagtgaagtaggagtggcctgggccactgttgaccaagacaaatcagatgggaggcggtggggatctggtgtattaaatgccctgccttctgatggtgagggaacactgcagttaggagcatggacactctggtgttggccaggcctggcttgaatccagcctctgtcacttaacctcactgaaccttagcagaatgggttcatcgtacctgcctcttgaggtggctggcagtgatgaaatgacacataaagc

SEQ ID NO: 1436 - DNA, 700 bp, Homo sapiens
aggcggtggggatctggtgtattaaatgccctgccttctgatggtgagggaacactgcagttaggagcatggacactctggtgttggccaggcctggcttgaatccagcctctgtcacttaacctcactgaaccttagcagaatgggttcatcgtacctgcctcttgaggtggctggcagtgatgaaatgacacataaagcacgtgcaccaggcctggtgtaagcagtgctcagacatgtgagctgttactagtggggcaaggagcggactctactaaggaatcctcctgtaagggcgggcctatgatggtgctggggagaatggctgcattgttatggtcaaaatccagttggcaaatgccacatggttctgggagggtgctggcccttctctgctgtcctctgttcaggaatggctgagtaggagctggcagtggcagacaaggccaggccaggagagcaggtagtccctggggagtctgccagacacctccataggtccatccacagtgctgagccccccagcccagctcctctctccctcatggctgggccgggccttggtccatggagatttttcctgacctacaggcatcttaggaccaggcccagcctgctcatgacctcatcttgggaatcacccaccctggagccctcatagctaggaccctggctagccgacactcaccttctggttctg

SEQ ID NO: 1437 - DNA, 700 bp, Homo sapiens
  misc_feature (1)...(700): n = A,T,C or G
tccatccacagtgctgagccccccagcccagctcctctctccctcatggctgggccgggccttggtccatggagatttttcctgacctacaggcatcttaggaccaggcccagcctgctcatgacctcatcttgggaatcacccaccctggagccctcatagctaggaccctggctagccgacactcaccttctggttctgggtgatgttgaccagctcctcaatgagctccctgagggctgtagagggaggcacagggcctggggaggcaaagccgccaaggcaagtgagagcaatgaccgtggtcaacaaaagcgccatgaggcccagtgccaacaggagaggattgaggagcggatgcnnangctgggtggcttgtggccttggcgtcttgtggcagcttttataggcccaagtggtgacgcctgacaccatggtctctgctttttcaggcactatctagaaaccacatctttactcatcttgattttactttgtggaaaatccagtgtcgcataaaggaaagagtttgatttctcatggacttattgagaagggtccagggcagagtttccaagatctgggtgggtttaattccagcggcaggcaaggggccctgagagcggcgtggcatttgcaatgctgccctgagttccagcagttttgcctgtgacaaccctgagtacctggacagctgacc

SEQ ID NO: 1438 - DNA, 700 bp, Homo sapiens
gaaaatccagtgtcgcataaaggaaagagtttgatttctcatggacttattgagaagggtccagggcagagtttccaagatctgggtgggtttaattccagcggcaggcaaggggccctgagagcggcgtggcatttgcaatgctgccctgagttccagcagttttgcctgtgacaaccctgagtacctggacagctgacccaactctgagctcctgtcctcagacccttttgggtcaccagaagtgctgagcagatagtcttagtgcactgtggctgtgaccacagtctaccagctatgggaatttggggagttttattttttcgatgaaccagtctcttaaattacttaagtaacacttgcttggatacaaaattcaaacaggcaatagaagagtaaagttcacttcttttggcttgcctaattcctccttggccccactgtgagagggattgtcaaagttcagatttccaggtctccactgagagatccagaaagattcagaggtctttctgggagcttttttggtgtttttttgttttgttttgttttgtttttttggagatggggtctcactatgttgcctgcctaggctggcctccaactcccagactcaagcgatccccccacctcagcttccagagtggctggaagtagtgtgcacgtgtctggcccctttaatttaaagtgtatgggccat

SEQ ID NO: 1439 - DNA, 700 bp, Homo sapiens
  misc_feature (1)...(700): n = A,T,C or G
ttcagaggtctttctgggagcttttttggtgtttttttgttttgttttgttttgtttttttggagatggggtctcactatgttgcctgcctaggctggcctccaactcccagactcaagcgatccccccacctcagcttccagagtggctggaagtagtgtgcacgtgtctggcccctttaatttaaagtgtatgggccatccttctgggaaactcttaactgggccaggctggcagccttagtccaggtcagagantgtnnnnnntnctagtgncactggggcttggggtgatccctttgctcaccagtctctgcaggatcaacccctgccgtctgggggcctcaaatttcccttctgcagaatgagtgctgtggagggcggctcctgggcttggcccctgcagccatgtcgccttttcctgctcttccctcnttttcctagaagtcctccagaaacccccacagcagaggccacggcatttgcctgttgggtgttgatgtcaagatttctcccctacccacttcctccccgaaccagcgcctccccaggccccctctctgcctgctcaggctccctccgtcctgtcctcgatggggctcaacctcctcacaagggtgtgcttgtgaccctcctcacaaggcatgctggattcccgctcagaggcatcccaggcttgcccaccctctcttcccacaggg

SEQ ID NO: 1440 - DNA, 700 bp, Homo sapiens
  misc_feature (1)...(700): n = A,T,C or G
tgtcaagatttctcccctacccacttcctccccgaaccagcgcctccccaggccccctctctgcctgctcaggctccctccgtcctgtcctcgatggggctcaacctcctcacaagggtgtgcttgtgaccctcctcacaaggcatgctggattcccgctcagaggcatcccaggcttgcccaccctctcttcccacagggaacgtcattcccaccctctctgtccacactcgaagcttcccagcccagctgctggctctgactcccagaagtctgccccttcccctcgagggcccccagtgcctggagtgccgctacttggccgtgtgaccccnctacgggcctgtttcctaatctgtagtagagggcccacggcatctcccacagggtctccgtgatgggggaaggagcggggaactaccttggtctgtgcaactcccggagccccgcccgggtgagtcaacgccccttatcccccatggccaccaaaagccctgccgggagcggtgggcaggggcgcccccgcgcgtgggagaaggcgctggcgcggcggttgcggcggcgatggcccgcggagataggggggtggccttatgtaacgggagatgggcccgataagcgggatctgcgcggccgggccctcctccgcggcctccggcggtggccggtccgggaggcaggggtgggcgcgcagaccggc

SEQ ID NO: 1441 - DNA, 700 bp, Homo sapiens
gggagcggtgggcaggggcgcccccgcgcgtgggagaaggcgctggcgcggcggttgcggcggcgatggcccgcggagataggggggtggccttatgtaacgggagatgggcccgataagcgggatctgcgcggccgggccctcctccgcggcctccggcggtggccggtccgggaggcaggggtgggcgcgcagaccggccagtctggaagctgcggaggctggcgagggggcggcaaaggtggcggtccgagcgccaggcagggcaagggccggctggacacccgggccagcggctccccgagcgccggtgcgcaccggcgaggggcgggagcggccgaggggccgaggcgcgcacgtgccgctccagcaccggccatgtcaggccgagggaccccgcgggcccggccgagcggcagcccctgccctggagggtggtctccagggaccaaggcgtggcgggcggtgcggagaggcgcggcacagatggctacatcagagggtctgttgcttgtttctagattgtcagcggggatccactcccgtgcgggtaattttaattaacactaactaccaaagggccgctccgggcacttggcgcatgtggctcgcacctgcctgcaatgcgctgcgtgggccgcccgcttatggccatggggagcctcttcgctttgctctggccccgaagcgctgggattgg

SEQ ID NO: 1442 - DNA, 700 bp, Homo sapiens
agggtctgttgcttgtttctagattgtcagcggggatccactcccgtgcgggtaattttaattaacactaactaccaaagggccgctccgggcacttggcgcatgtggctcgcacctgcctgcaatgcgctgcgtgggccgcccgcttatggccatggggagcctcttcgctttgctctggccccgaagcgctgggattgggacctcccttcctcccgaccagctcatcctgggaaagctggggttgctttttcgggtttctctggactctgggtctccgttggcaaagacatgatgcccagtcaggaggagtaaggcctgagagagttgtttttgtaagtgaaaggatttaattttttagatttttatttttaggaaagttacgaatgcagataattttaaaaatcaagaaggctgattatgtaaaacggcagcgctgggaatccgtgctctatgggcctctggcattgctgctcctcttgtgagtgaggcacttactgccctgctgtgtcccttactgtcttttaaaggttgtttataggccgggcgcggtggctcacgcctgtaatcccagcactttgggaggccgagatgggcggatcacgaggtcaggagattgagaccatcctggctaacacggtgaaaccccgtctctactaaaaatacaaaaaaattagccgggcgtggtggtgggcgcctg

SEQ ID NO: 1443 - DNA, 700 bp, Homo sapiens
gccctgctgtgtcccttactgtcttttaaaggttgtttataggccgggcgcggtggctcacgcctgtaatcccagcactttgggaggccgagatgggcggatcacgaggtcaggagattgagaccatcctggctaacacggtgaaaccccgtctctactaaaaatacaaaaaaattagccgggcgtggtggtgggcgcctgtagtcccagctacccaggaggctgaggcaggagaatggcgtgaacccgggaggcggagcttgcagtgagccgaaatcgcgccactgcacttaagcctgggcgacagtgtgagactccgtcttaaaaaaaaaaaaaaaaaaaaaaaaaggttgttaagaaaatcacaaggaaggaggaaaaaatatatttcctattcattaagtggaggtggaacatcacaaaggtcttcagcgtcactgtcttcacgttgagcaggccgaggaggaagaagaggaggggtcggtcttgtcatctcaggggtggcagaggcaggagagaatccgtggataagtggatctgtgcagttcagaacctgctgttcaagggtcaactgtgtatgtaaaaaattcagtggaatctccaccttccctcacaagtaactatttttcttaggtgttgtttttttttttttttggtatcctattagtttatgtaaatacaagcaactgtgaatatatgg

SEQ ID NO: 1444 - DNA, 700 bp, Homo sapiens
ggtggcagaggcaggagagaatccgtggataagtggatctgtgcagttcagaacctgctgttcaagggtcaactgtgtatgtaaaaaattcagtggaatctccaccttccctcacaagtaactatttttcttaggtgttgtttttttttttttttggtatcctattagtttatgtaaatacaagcaactgtgaatatatggtcttattttcccttgtccctacatgtgaagtggcatcatatacaccttttgcaccctgtttttctcacttactataaaaataatatatttttgtattcacacttagattgggacattttatgacttttcttctttgttctctcttattggaactgccattttttttgactatatacctcttggacttgtcctttaattttctttttattctattttccatttaaaaaatttctcttctctgggatattctcatagctttatcttcctgagggtatttgattctttgtgtgtgtgtgcgcatgtgcacatgcacgctaacagcactatgttcttgtttcattgatatcttctaagtttcctttttcatacataatctttattttctgcaagttttctttaaaaaattgttttgaactgggcgcggtggctcacccctgtaattccagcactttggggggccgatcgcttgagcccaggagtttgacaccagcctgggaaa

SEQ ID NO: 1445 - DNA, 700 bp, Homo sapiens
catgtgcacatgcacgctaacagcactatgttcttgtttcattgatatcttctaagtttcctttttcatacataatctttattttctgcaagttttctttaaaaaattgttttgaactgggcgcggtggctcacccctgtaattccagcactttggggggccgatcgcttgagcccaggagtttgacaccagcctgggaaacatagggagactttacttctacaaaacataaaaaaaacttagccaggcatggttgtgcatacctgtgatcccagctacttgggaggctgtgtgggagcatcacttgagctcaggagtcgaagctgcagtgagttgtgatcacaccacttcactccagcctgggtgacagagccagaccctgcctcaaaaaaaattttttttccatcttataggctttccttgcacgttaggtaatcctggattgcctgcacatgttaaaacagggatctctgagggtaattgtgtgggagggggctgtttcctatagggcaggtggctgactgttttcacttggggaacctcctgtggcagtttctttgtcgtttttttggcaggcaggtcagctcgcgcagaaaagattctccctgtctccagcattccagcagcaagggtggagagagggctggggtgggggcctcagcatctgttgactgttcctgatttcagcatatttcgaccg

SEQ ID NO: 1446 - DNA, 700 bp, Homo sapiens
ttcctatagggcaggtggctgactgttttcacttggggaacctcctgtggcagtttctttgtcgtttttttggcaggcaggtcagctcgcgcagaaaagattctccctgtctccagcattccagcagcaagggtggagagagggctggggtgggggcctcagcatctgttgactgttcctgatttcagcatatttcgaccgccctctactgtgtctagtgtttcttggtccagatatcctatccggagaaaaccctgctgcaggagagtcactcgactttgatgaacaaaaatggatatctaactgtttcttaaactgagtttcaacaactttccttattttcacccccttctcttctgatgtccttggtcttctcccagttcctgagcattcttgggattctgtaaatcaacataggtctcagctggcctaggattcagttttcttgggtcagccaagtagtctgcccaccgtccctccactttccacctttcaaacgctggtgctgtcatccatttctcccattttggtgggtttaaaactttagaaaattcagttactgtcattttagttggttataaagtgggagtttgtgtttattccattgttttcatttggaatttatatttttaatgtagagaatttataaacaagacaagaaataagaggcaaacactagtcttgcaccccttttccctgg

SEQ ID NO: 1447 - DNA, 700 bp, Homo sapiens
ctggtgctgtcatccatttctcccattttggtgggtttaaaactttagaaaattcagttactgtcattttagttggttataaagtgggagtttgtgtttattccattgttttcatttggaatttatatttttaatgtagagaatttataaacaagacaagaaataagaggcaaacactagtcttgcaccccttttccctggcactataacacctctgtatctttgctatgcacatttacattttgttagaaaaatgagataatacattatatagtttttactcctttttcacttaaaatatatgaagagcattctccaatgtcagtattctgcatttaaaaaaagattacacaaaatgttattgtgtaaagtacagatatgcaaaaaaataaaaagccccatagtcccagcatccagagataataatcattgtaatattttggtatctgtcatgctagtatgtggatatgtacagggtaagtaccttattcctaaaataaaagggaaataactttttttctttttcttttttttttttttgagacagagccttgctctgtcacctacgttggagtgcagtggcaccatcttggctcactgcaacctctgcctctcaggcacaagcaatcctcccacctcagcctcctgagtagctgagactacaggtgagccaccacacctggctaatttttgtattttt

SEQ ID NO: 1448 - DNA, 700 bp, Homo sapiens
aaagggaaataactttttttctttttcttttttttttttttgagacagagccttgctctgtcacctacgttggagtgcagtggcaccatcttggctcactgcaacctctgcctctcaggcacaagcaatcctcccacctcagcctcctgagtagctgagactacaggtgagccaccacacctggctaatttttgtattttttgtagagaccaggtttcaccatgttgcccaggctggtctcatactcttgggctcaagcaatttgcctgccttggactcctgaagtgctaggattacaggtgtgagccactgtgcctggctgacatattttatttacttattagtattttttttgagatggggtctcactctgacacccaggctgaggagcaatggtgcaaacacggctcactgcagtctcaaacccctgggttcaagtgatcctcccacctcagcttcctgcgtagctgggactacagggcaccatcatgcccacacacattggctgatttttaatttttttttgtagagatagggttaaacctttagacttaccacggttttactaataccagatcaaagaggtgcaagataaatgtttgccttttattgcttgtctcttttataaattctctgcattaaaaatataaattccaagtaaaaacaatggaatgaacataaactcccacttcataaccac

SEQ ID NO: 1449 - DNA, 700 bp, Homo sapiens
cattggctgatttttaatttttttttgtagagatagggttaaacctttagacttaccacggttttactaataccagatcaaagaggtgcaagataaatgtttgccttttattgcttgtctcttttataaattctctgcattaaaaatataaattccaagtaaaaacaatggaatgaacataaactcccacttcataaccactcaaaccatagtagcaacaaccttatcctgttgcccaggttggtcttgaactcctgtgctcaagtgatcctcttatcttggcctcccagtgtgctggaatcacaggcatcagccactgcacctggcctattacttaatctaatacatttctgcgccaagccccggaagacaaataattacaaataattcccataacaatgataagttcatacattcattaagtaaatgtttattgagtgcttactgtgtaggtgctaaacaaaacagcacagtctctgccctcttagagatacattctagtgggtagagataatgaacaaacacatgatatatagtatgttagaccgtgaaaagtacagtggagagggaaaaaaaagagggcaggtagaatgagtgagtacactattatatatgggatggtgacgtaaggcatcactgagaaggtgttatttgagcagagacctgaaggatgagaggaagtggccatgcagatatttgg

SEQ ID NO: 1450 - DNA, 700 bp, Homo sapiens
agtgggtagagataatgaacaaacacatgatatatagtatgttagaccgtgaaaagtacagtggagagggaaaaaaaagagggcaggtagaatgagtgagtacactattatatatgggatggtgacgtaaggcatcactgagaaggtgttatttgagcagagacctgaaggatgagaggaagtggccatgcagatatttgggggaagaaatttccaagctgaaggcacaagtaagtgcaaaggcccttttcttattttgttcatgctgctgtaacagaacacctaagactgagtaatttataaataataaaaatttattgcttacagttctggaggttgggaaatccaagatcaaggctccagcagaattcgtgtctggtgagggctgctctctgctcccaagatggtgccttcttgctgtgtcctcatgtggtagaagagccaaagggaagaactttctccctcaagcccttttatgaggtcatgaatcccattcctccatggcctaatcaccttttaagtgccccacttcttaatagcatcaccttggggattaagttccaatgtatgaattttggagggaaacatacactcaaaccatagtagcaccaaagcaggaaaatgcccactgtgctgagaattagcaaggaaagccagaaggagtgaggggaggcatgggagaagatactgtcagagaagt

SEQ ID NO: 1451 - DNA, 700 bp, Homo sapiens
catggcctaatcaccttttaagtgccccacttcttaatagcatcaccttggggattaagttccaatgtatgaattttggagggaaacatacactcaaaccatagtagcaccaaagcaggaaaatgcccactgtgctgagaattagcaaggaaagccagaaggagtgaggggaggcatgggagaagatactgtcagagaagtatgtccagagcatatggagacttgtaagccattgagaggactgaggatttcatgatgagtgacatagggagccactggaggttttgagcagaggagtgacatgactcaatttaccttttttctttttttaaaaaaatttgaattaacgttatatttacggaaaagatacaaaaatagtacagacagtttccatatcccctccacttacccagcttctcccaatggtaacacattacataatcatagtgcaatgatcaaaaacagaaaaatgagcatggatttattaagtaaactggatcctattctaatctcaccagtgtttccattcacatcctttttcagtttcaagatcaacccaggatctcacagtgcattgagttaattctctttggtctcctgcagtctgaatggttcctcagtcttgtctttcataacgcttacattttccaggaatactgatgagttatgctgtcaaatgttcctcagtttggtccccttg

SEQ ID NO: 1452 - DNA, 700 bp, Homo sapiens
cctattctaatctcaccagtgtttccattcacatcctttttcagtttcaagatcaacccaggatctcacagtgcattgagttaattctctttggtctcctgcagtctgaatggttcctcagtcttgtctttcataacgcttacattttccaggaatactgatgagttatgctgtcaaatgttcctcagtttggtccccttggtgttttctcctaattgcactgaggttctacattttcacagagatgaagttggggccttctcactgcatcaggtcacagggttcatgaggtacatgccttcttattggtgatgttgaccctgaccacttggttaagatggtttctgtcaggttcttccatgataaaattactatctttccctttttagttaatatattgggaaagatagtttgagattatataaattttttctcagatttgtgcctactaatattagcttcatcagtgactcttgtctgaaatgatttttattgtggtatttgcctagtgatgacttttctttttccctttccttctacatttattacttgtaattctactataaagaagtgctgtccttgtccctcattttttttaaagtaagtacttgtgtatagccacataagttcatgaatatttattttactctatcggttataatccaatactgtctttattttgtttctcaaattgttctac

SEQ ID NO: 1453 - DNA, 700 bp, Homo sapiens
atttgcctagtgatgacttttctttttccctttccttctacatttattacttgtaattctactataaagaagtgctgtccttgtccctcattttttttaaagtaagtacttgtgtatagccacataagttcatgaatatttattttactctatcggttataatccaatactgtctttattttgtttctcaaattgttctacctttgatcattgggagttacttcaggttgggttctgtgttctttgaacaaactctacctttttttttaaaaaaaatattttcttaatttctggcaccacaaaaaattctagggtcattttgtattttccttgcctcagccctgaagtcaaccacttcaccaaggagccagagttctttttattgaagagcgtgttttaaaatcgagatcttggaagtaggtgtcctcattattactggggtgtcatcacactgggccctctttaaataactttgttactttcactataagttttcattattttcttagtggttaccctggggattacaaatgaacaccttaatttagatgaatgtcaacttaatttccatttcaaaagttcctatatagctctgttgcctctctcttttgtagcattattgtcatataaattatatttttatacattataagcccatcaacagtgttaaaattcttaatgcagttccctttcaatcatg

SEQ ID NO: 1454 - DNA, 700 bp, Homo sapiens
attttcttagtggttaccctggggattacaaatgaacaccttaatttagatgaatgtcaacttaatttccatttcaaaagttcctatatagctctgttgcctctctcttttgtagcattattgtcatataaattatatttttatacattataagcccatcaacagtgttaaaattcttaatgcagttccctttcaatcatgtaggaaaagagttacaacccaaaatactttttttttttttttgagaccgagttttgctcttgtcaccaaggctggagtgcagtggcgtgatctcagctcaccgcaacctccgcctcctgggttcaagagattctcctgcctcagcctcctgagtagctgggattacaggcgcccaccacaacgcctggctgattttttgtatttttagtagagacagggtttcaccatgttgggcaggctggtctcaaactcctgacctcaggtgatccgcccacctcggcctctcaaagtgttgggattacaggcatgagccactgctcccagcccccaaaatacatttatacttttatattacctatatatttacctttaccagtactctttatttgagtattcatgagcatttgagtctagtttcattttaccctaaaggattcattctccttttatatttcttgtagggcaagtctggtgaagacagattatcacaatgtttgtt

SEQ ID NO: 1455 - DNA, 700 bp, Homo sapiens
ttacaggcatgagccactgctcccagcccccaaaatacatttatacttttatattacctatatatttacctttaccagtactctttatttgagtattcatgagcatttgagtctagtttcattttaccctaaaggattcattctccttttatatttcttgtagggcaagtctggtgaagacagattatcacaatgtttgtttatatgggagtgtcttcatttcttgtttttgaaggacagtttttctggatacagaattcttgattgaggctgggcacagtagcccacaccttaatcccagcactttgggaggccaaggtgggaggactgcttaagactaggagtttaagaccagcctgggcaagacagcaagaccccctgtctcttaaaaaatttttttttttgagtgtggtggcacatgctggtagtcctatttgagaggctgaggaaagagaattgcttgagcccaggagtttgaagctacagtgagctatgattgcaccactgcaaaaataattcttggttgatagtctttttcattcagcactttgaatatgtcatctcactgctttcaggcctgcattgtttcttaagagaagtcacttcttagctttacttgcttctttcgtttgagatctctttttcaacaatttgaccatgatgcatctaaatgtgaatccctttgagtttaccctacttg

SEQ ID NO: 1456 - DNA, 700 bp, Homo sapiens
caccactgcaaaaataattcttggttgatagtctttttcattcagcactttgaatatgtcatctcactgctttcaggcctgcattgtttcttaagagaagtcacttcttagctttacttgcttctttcgtttgagatctctttttcaacaatttgaccatgatgcatctaaatgtgaatccctttgagtttaccctacttggagtttgttcaatttcttggatacgaagattaatgttttcataaaatttgggaagttttgggctactatttcttcaaatagtctttctgctcctttctctctctctctcttctgggattctcattatgattggtatacttggcattttggtacacttgatagtgtctcaaaggtctctgaagctctcttcatttttcttcattcttctgtctattcctcagactgtataatctcaattgaccggtctttgaactcactgattctttcttctgccagttcaaatttgctgttgacccccatctagtgaatttttatttccattactgtatttctcaactccagaatatctatttgattcttttttataatgtttgtctccttactgatagtcctgataatttggtgaaacatcattctcataatttcctttaattctttagactttgtttctgttagttccttgaacatgtttataatagctgatatctaaagtctttgc

SEQ ID NO: 1457 - DNA, 700 bp, Homo sapiens
atctagtgaatttttatttccattactgtatttctcaactccagaatatctatttgattcttttttataatgtttgtctccttactgatagtcctgataatttggtgaaacatcattctcataatttcctttaattctttagactttgtttctgttagttccttgaacatgtttataatagctgatatctaaagtctttgcctagtaagtctaacatctgggcttcctcatagattgtttctattgactgttttttaaattgctgtttatggcatgggtcagatgttcctgttctttgtgtgtcttgttttaaatactctatcaattattgaagtcagattacctactctccagggcttgcacctgttactatttcttattgttgctgctgttggtttgttctgtgtctttcctggactaattctgcaaattctatatgctttgtcatgtttggttcctgaagtctctactcagcctagtgggtaagcgaataattggacagatatttctttctaatgccttgaaccaataaattttctagcttttgtcaagtgtgtgcatgtgtgtgtatttgtggagtcatgtcattgatgtgtcagcagacagtttacaactgcctttatcttcatttctggcatgaattgagtttcaaggtcagtcagagatgagagcttaggaccctctcaggacatgcatacat

SEQ ID NO: 1458 - DNA, 700 bp, Homo sapiens
cagatatttctttctaatgccttgaaccaataaattttctagcttttgtcaagtgtgtgcatgtgtgtgtatttgtggagtcatgtcattgatgtgtcagcagacagtttacaactgcctttatcttcatttctggcatgaattgagtttcaaggtcagtcagagatgagagcttaggaccctctcaggacatgcatacatccctgcacatgcacatggacttctagattcccaggaatatgcttgagcttgtcaaagctcccgtggacatcttcttcccagatttttccttttaagtttcttggtcagccttttgttagctccacctggtaacgctgcctcaggcagccacagggttaatcagttgccactgattattctgcaggaagggctgttttcagagtgagctctgagttaagtcaaataaagataggtcctgaaaatggagcttttcagtgagttgccagacaagacaaatagaggcagttctctagtagtggagatctgggggacctccaaatctattctgtctcctccagtggctactaggttgctgattttcacagatactaagagggctgttggttttcaagttaccatggattaagagagaagggcatgggattagggcaacttaaaatgccactttctgctctgagattcagctgttttcctttaataaacacacctcagtttgtcg

SEQ ID NO: 1459 - DNA, 700 bp, Homo sapiens
gagatctgggggacctccaaatctattctgtctcctccagtggctactaggttgctgattttcacagatactaagagggctgttggttttcaagttaccatggattaagagagaagggcatgggattagggcaacttaaaatgccactttctgctctgagattcagctgttttcctttaataaacacacctcagtttgtcgctatccattagttaatttccaaagttctgaaaaagttgattttgacatttttgccagtcttattgcttttatgaagaagcagattttggatggcttttactccacccttatggaagtagaaatcctttagatattaaaattataaatttgtacagatcctttggattcaatcaacaccaaggggttctttttatggcctcctttcctgatatgcaaacacctttttccaacagtgagaaactcagttcgtattatctacaacacaggtatgtatttgtttgactttagtatgtacataaaaatttcgaaattgctaacccacacccctgtgagaaacacattttcttgagttactttttaaaaagatcactggctgctgtgttgagaactacagggagcaggccccaaatcagtgggagcagttacgtggttactcagattattcaggttagagatggcagtggcttggaccagagcaatgatggtttagatcaggggt

SEQ ID NO: 1460 - DNA, 700 bp, Homo sapiens
aaaatttcgaaattgctaacccacacccctgtgagaaacacattttcttgagttactttttaaaaagatcactggctgctgtgttgagaactacagggagcaggccccaaatcagtgggagcagttacgtggttactcagattattcaggttagagatggcagtggcttggaccagagcaatgatggtttagatcaggggtccccaacccccgggctgcagaccattacctgtcctcagcctgttaggaacagagtcgcacaacaggaggtgagtgacaggtgagggagcattaccgcctgagctctacctcctatcagattggtggtggcattagattctcacgggagtgcaaactctattgtgaatttgcacgtgagggatctaggttgcgtgctccttatgagaatctgactaatgcctgatgatctgagatggaacagtttcatcccgaaaccatccccctcaccccacccgtccatggaaaaattgtcttccactaaatcggtctctggtgccaaaatggttggggactgctggtttaaatggtgaggcatggtcagattccggatgttttgaaaattgaacccatagtattaaactgacgaattagatataagatgtaagataaagaatcaaggataatgccaatttttgcctgagcaattggaataatggagttgccattaacagaagagatt

SEQ ID NO: 1461 - DNA, 700 bp, Homo sapiens
taaatcggtctctggtgccaaaatggttggggactgctggtttaaatggtgaggcatggtcagattccggatgttttgaaaattgaacccatagtattaaactgacgaattagatataagatgtaagataaagaatcaaggataatgccaatttttgcctgagcaattggaataatggagttgccattaacagaagagattcaagttctgggagaaagactggttttggtcattttaagttttagacgtttattagatattcaagtgcagatagatgcccagttatccacaggcagctgaatatatcagtcaagcatttaggagagatctggattggacacaaacatttatgagttatcagtgtatagatggtggttgtaggagtggtcagtgccctgcctatatcctatgatcctaggaactgccagtgtgctcctgccaactttcagctgctgctgctttttttttttttttttttttgtctttttagacagggtctcactctgccacccacccaggctggggtgcagtggcacaaatcacagctcactgcagccttgaaccctcagactccagggatcctatctcagccaagtagctgagactacaggtgtgcaccaccatgccttgctaattttttaaaaattttatgtaaagatgggatgtcactatgttgctcagactttctttttaaactgtg

SEQ ID NO: 1462 - DNA, 700 bp, Homo sapiens
cactctgccacccacccaggctggggtgcagtggcacaaatcacagctcactgcagccttgaaccctcagactccagggatcctatctcagccaagtagctgagactacaggtgtgcaccaccatgccttgctaattttttaaaaattttatgtaaagatgggatgtcactatgttgctcagactttctttttaaactgtggaaagcagctgtgtcggtacacatggcaagccagtaactaacatgtgctagaatagccttcactcagtaaccctggcaagttgttatataaatactccaggtctcttgccccttaggtgggataattctgaggtatatattttgccaaactccccagagtctccctggggcaccaaactctaattgcccacttaccgtagctggcttaatagtaaacttttcattggctgctttctctttcatacacaatttccccaatttcctactgattactttcacgtgaagcattgttttacgctctgcttctgggagaacccaaactaagataatttaaagctatgagactggatgagatcaccaaataagtgagcacagagaagaaaagaggtgcagactctgagtactaaaacctgtgacattgaggggccagggaaatgaggaggaaacagcaaaggaaacgggatgtgcaggtgttgcagggaggaggcagagctggatt

SEQ ID NO: 1463 - DNA, 700 bp, Homo sapiens
tctgcttctgggagaacccaaactaagataatttaaagctatgagactggatgagatcaccaaataagtgagcacagagaagaaaagaggtgcagactctgagtactaaaacctgtgacattgaggggccagggaaatgaggaggaaacagcaaaggaaacgggatgtgcaggtgttgcagggaggaggcagagctggattccagtagggctggggattgtcgggacagtttgagtacaatgcagtggagggtgacataatgatgagccatggaatttaagttgaataaggagagaagtacaggcatcagggaaacaacctgtgaaaaagccatagaatcaatggattgaaatctcagtggggtcaaagaattgctggggttgaggaccacaggaaaattgtagacaccatggggttattggagagtgagatgcttaaaactgagattttggaggggtgcagttattgttattaaaaggacggggctctagaataagaccatagaactgagtatcttctcactggaggaaacaaaaaggggctgagggaggccaaggtaggcagatcacttgaggccagacgttcaagaccagcctggccaacaaggcgaaaccctgtctctactaaaatacaaaaattagcctggtgtggtggtacatgcctgtaatcctagctacttgggaggctgaggcaggaggat

SEQ ID NO: 1464 - DNA, 700 bp, Homo sapiens
catagaactgagtatcttctcactggaggaaacaaaaaggggctgagggaggccaaggtaggcagatcacttgaggccagacgttcaagaccagcctggccaacaaggcgaaaccctgtctctactaaaatacaaaaattagcctggtgtggtggtacatgcctgtaatcctagctacttgggaggctgaggcaggaggattgcttgtatcagggaggcagaggttgcagtgagctgagatggtgccattgcactccagcctgggtgacagagcaagactccacctcaaaaaataaaaaagactgagaggccaaggagttgtattagaccatcacttggatattgaaatcagcaatgattattagtaatggggtgacactgaaccgggagctaaactcttcaacaaataagagggagtgaccaagctgggaatgaaagataactgcaacaagagtgaaatgaagacagctttttcttgaacacttacacagtatttagtaggtggcaagcagttctaagcagtttgtaaataatgtcattcaatcttcataacaaccctacaaaatatgtaccattttacccacttttacatataaggaaacagaaaacaggacaaataacttgctcaaggtccccagctagtgagtggtgtgctaggatttgagcccaggcagtctggctcattctaacctccatccat

SEQ ID NO: 1465 - DNA, 700 bp, Homo sapiens
  misc_feature (1)...(700): n = A,T,C or G
aggtggcaagcagttctaagcagtttgtaaataatgtcattcaatcttcataacaaccctacaaaatatgtaccattttacccacttttacatataaggaaacagaaaacaggacaaataacttgctcaaggtccccagctagtgagtggtgtgctaggatttgagcccaggcagtctggctcattctaacctccatccatgctgtgatggctattcattccaatgtggggaagggggatatttggagactgatctagaagcagcaatgagaagccagaaaggcacctatcccacctccaaacccatgggcttcttggaatgaaagcagccactctcagaagtgctgccaaggatgccacatattcagggggaaaccagatttaaaattgggaagtctgttttaacttgcaaatgatacttttgtttcactgcctatattgatcgtgtattgcctttgttattctttgctgcaacaactagcactttcattaacatgttgatagaaggtaactggctttaatatttactgagaaatgttttattttgcagttaagatgactgtttaattttgatttagcaacagataacattaagaaaatattatttgcaaaactgtgagtttgctaaagctaggagatgttgaattttatcaaatatagctgctaganttttttcagaatttttttcaccttcggtttt

SEQ ID NO: 1466 - DNA, 700 bp, Homo sapiens
  misc_feature (1)...(700): n = A,T,C or G
gatagaaggtaactggctttaatatttactgagaaatgttttattttgcagttaagatgactgtttaattttgatttagcaacagataacattaagaaaatattatttgcaaaactgtgagtttgctaaagctaggagatgttgaattttatcaaatatagctgctaganttttttcagaatttttttcaccttcggttttattatagtgatggatttatcaacagatttttcattttctgaaatcttgcattcttgggataaaaatatcttggttattgtggatgtttaatatatgactagaattgatttgctcttaatcttactcgtgattacatttaggacccccccccaccccaccaccacccccaggatactctgtcttaaggtccttagctttaatcacatctgcaaagtttcctttgctgtataaagtaacagtcacgggttctagaaatcaggacctgtctatctttgggggccaaccatttaacctagcacagatagatgccttaggaccttagggcttaattctcttctggacccagttgagaaaagctgtctaggcaaacatgctcattatagctacagatggcacaaaaccatgccatgtgactgaatcaagacccggtatggtcctggctgactctgaatgacaaaactctacaaagcataattcaaaagcgtgtgacttggttgca

SEQ ID NO: 1467 - DNA, 700 bp, Homo sapiens
cagatagatgccttaggaccttagggcttaattctcttctggacccagttgagaaaagctgtctaggcaaacatgctcattatagctacagatggcacaaaaccatgccatgtgactgaatcaagacccggtatggtcctggctgactctgaatgacaaaactctacaaagcataattcaaaagcgtgtgacttggttgcattctgtgtggaatggaaggattcaagatgtcagctggcaattccaggaaaaactgtgattaggcttttcttagaagtggcatctgaagagcaaatggagaggcctgttcttccaggtctggttggaccctacagggagcaggccttgactctgtgagtgagcctggcttgccttccacatggcaatgcccacttagagaggaatcaggattgatggtgaagccagtatgctacacaggatagacgcagaggagtgttacaggcttcttcacgatgggcagatcaggcctcaagtggtcagagctttccaaaggtgggtgtgcacagtggagaatttcctctctgtagagagagctctgagtctggatgaccatctggaagggatatgtaggagaagaaggtggtgggtactgacttagatgattacttaaggttcctgtcaaactttgagaccccattcaactacttcaaattttagttggggaaaccaagtcccagag

SEQ ID NO: 1468 - DNA, 700 bp, Homo sapiens
agagctttccaaaggtgggtgtgcacagtggagaatttcctctctgtagagagagctctgagtctggatgaccatctggaagggatatgtaggagaagaaggtggtgggtactgacttagatgattacttaaggttcctgtcaaactttgagaccccattcaactacttcaaattttagttggggaaaccaagtcccagagagagaggtcactggatttataaagttaaaagcagagccaaacatacatctcaccatttctggtcatcctcagatattaatactcagtttttcaaaccacatgcaaggaagtaaattcagaggtaacatttaactatgatttaaaaaaataccaaaaccataaattttcaaggcagtaattatctccttctcaacagtgctttgagaagaagcatgcatttgcactggggagggaggcacagagtcgagtctcggctgtactgctgaaccctgaaggcctgacagaggctgcctggaatgggatgaagagcagcaaatcagaaacaggcaatctgtccaattttcagtgaaacaagtttcatgattttagaacctctcaacatccaaaatcctagacacaatgttcctttgaaagaatatattttcttattgactaagttgatatgagaaataagtttcttattatacactttctgaggacctacatttctatggcattt

SEQ ID NO: 1469 - DNA, 700 bp, Homo sapiens
gggatgaagagcagcaaatcagaaacaggcaatctgtccaattttcagtgaaacaagtttcatgattttagaacctctcaacatccaaaatcctagacacaatgttcctttgaaagaatatattttcttattgactaagttgatatgagaaataagtttcttattatacactttctgaggacctacatttctatggcatttaaatcttggatatttttaatgaacattgaatcccagggagctaacactgcatttcacaatctctgagcactgatcgatgttctttttaatcctgtagaatttctccacatattcagaacgtcctaaaagctccacaaaatcttcatcatgagtgattaccagaagctggaagttacgctgctgtgagcgactttttattatcctgcaacaatatattcagaacatattattagtaaagagcataaccccttctttgatttgaaaagtcaccgcaaaccttgtcagacacatgaacttgtgctgtgtgtcagggccccagctaccctgcaggaagtggaggggtggccccaggccttcaggccagccaggcaggagtctcttctcctctccagacagtagggacacatggcctgactcctcacttaggtctggcttagggactcacaggaatacaagaactagtttcttccagatcagaagttctcactaaagcaggtat

SEQ ID NO: 1470 - DNA, 700 bp, Homo sapiens
tgctgtgtgtcagggccccagctaccctgcaggaagtggaggggtggccccaggccttcaggccagccaggcaggagtctcttctcctctccagacagtagggacacatggcctgactcctcacttaggtctggcttagggactcacaggaatacaagaactagtttcttccagatcagaagttctcactaaagcaggtataaatattttattgagttttccttaatatccaaactgttcaactatagaaggcttactccttcgcctgggattttcctgacctgttactacttttctctggaagaaaaatttaaaagtaataaagacaaactacaggtaaggggaataacactgctttcttaagagctgggtctacttagaattctgccaccaccagtcactagatgcatcattactatgacacacagggacctgagtgggtgttctgggaacattttgctgaggtaaccagcaatgtgactgaaacctgaaagactttttcttttagctagccacttatccccttcctggagctggatgcatttgaggtttcaaaagcactcgcccttacttgtgatgatggctgcagaaaggtggccctgcgctgctgagctctccttctggccctctctgccagaaagggactgtctggagccaggagtgcctgaaacacctcctttgacctcagggaaactgcctt

SEQ ID NO: 1471 - DNA, 700 bp, Homo sapiens
ttcttttagctagccacttatccccttcctggagctggatgcatttgaggtttcaaaagcactcgcccttacttgtgatgatggctgcagaaaggtggccctgcgctgctgagctctccttctggccctctctgccagaaagggactgtctggagccaggagtgcctgaaacacctcctttgacctcagggaaactgcctttttctctgccagcatagtccttatgcaagagctgcttgacaaccttggcgtctacactgaccccaggtgaatgtggtaaaaggtgtgcaattttaccctcactggactttacctaatctcaaataagctttttgagtaagagctctgtcattcctcacagttctctgacacatgtggaaagctggggagacagtcctaaacccactaccactacctgcagatgtcttagcagggcatgctaattgctgtgcatgacatgtgggttcctctggtaggtttacaggaaaaccaggccaggaacccctcacagtgactctctccctgtgaacacacttggggagctgcaggatgtgtctggggctgctgttcaccatctagttcctttaggagggatctgaagaattactatcaaaaggtaaagcccagggcctggcaccaactggcttccccaagaagtggggaacacagctagagaacgttttcatcacagaactctctt

SEQ ID NO: 1472 - DNA, 700 bp, Homo sapiens
aacccctcacagtgactctctccctgtgaacacacttggggagctgcaggatgtgtctggggctgctgttcaccatctagttcctttaggagggatctgaagaattactatcaaaaggtaaagcccagggcctggcaccaactggcttccccaagaagtggggaacacagctagagaacgttttcatcacagaactctcttggttttgaagaactatcacaacctgtccccaaatgtgagatacttactcaaccagagcatgtgcaagagatacttactcaaccagagcatgtgcaagagattcaatgttttctcggtcaagatttgttgttggctcatccaaggcaatgatgccacagttgaggcagaacgtttcagccagggccaggcgaatgatgagtgaggctaatacctggaaaaaagcccctatgtgagaagcccagcacagaccttctcatctcatggcaggcaagcagtcctgacatgatcttttcagcagggaaaagtgggaaacgtcacaggttcactgttaggtaaagcactgccctctgggagagcccagcactgggaccagattcttatgtcctccagaaggagaacctgcatgatctcagcctatcattcaccacaaaacaaaatgctcagaacaacgctgatgctctcacataaaaaattacatcagctacaaccaacttgagac

SEQ ID NO: 1473 - DNA, 700 bp, Homo sapiens
ggaaaagtgggaaacgtcacaggttcactgttaggtaaagcactgccctctgggagagcccagcactgggaccagattcttatgtcctccagaaggagaacctgcatgatctcagcctatcattcaccacaaaacaaaatgctcagaacaacgctgatgctctcacataaaaaattacatcagctacaaccaacttgagaccaaaggctagaaacagagacaatgccatttatctgtaattttaataatcctgtaagatgagcaaccttaaaaattcttgacctggctatttgcctgataatgggatctgttagaaaacttcgacacgttttctagagcctctcactttttctctgctacctttaaatttccatattcttgtgtataatcctgagactgagagaataaaaaagaaaatcctaggtcaaagtatcaggagtatagaaatgtggtttcagttaagcttacctgtagaaaatccaagtaactggaactgttaggcattttcgtggttactagaaacctaatactaaaaccctcagacccactgaaaccatctgaggatacaagacacacagaattgagagagtagggctattctaggaagtataaactactctggtgtgagctgtaagtcccctttccccctcagtttgtgggtgggtgcgcacacatcagtgagttggtaattttagaatag

SEQ ID NO: 1474 - DNA, 700 bp, Homo sapiens
ggcattttcgtggttactagaaacctaatactaaaaccctcagacccactgaaaccatctgaggatacaagacacacagaattgagagagtagggctattctaggaagtataaactactctggtgtgagctgtaagtcccctttccccctcagtttgtgggtgggtgcgcacacatcagtgagttggtaattttagaatagtttatgtcttttctttaatgcctaggcaagccagaagacagggccacagcttggccctgtgagggacaggcatttccttcctgtctttgaatccaaactgctgtcaactctaccaccacccactcacatgcagagcccctggctggctgctagagcctcagcaaaagccagtgttaggtaggctggaggcccacctccattatttgttctctcccctcacaccaaggagacaattattgctaattaattttcataactcagaatagctacaaaaaatctttttcctcaagatatttttgaaagtatttttaattcaaagagaccatgtttcaaactctgtattttctcatttataattaccactaaaaatcatcaaagcacgtagggatactgattacagatcacaagtttgtcatttttgtagactatgatttagacagtaatctgcagatgctttaaattgggatcagctgtctaggctgacaacataatacatata

SEQ ID NO: 1475 - DNA, 700 bp, Homo sapiens
gaaagtatttttaattcaaagagaccatgtttcaaactctgtattttctcatttataattaccactaaaaatcatcaaagcacgtagggatactgattacagatcacaagtttgtcatttttgtagactatgatttagacagtaatctgcagatgctttaaattgggatcagctgtctaggctgacaacataatacatatatgcatggcatgttcttttttttttttttttttgagacggagtttcgctcttgttgcctgggctggagtgcaatggcacgatctcggctcactgcaacctccgcctcccaggttcaagcaattctcctgcctcagcctcccgagtagctgggattacaggcacatgctaccatgcccagctaatttttgtatttttaatagagacggagtttcaccatgttaggctggtctcgaactcctgacctcaggtgatctgcccgcctcggccttccaaagtgctgcgattacaggtgtgagacaccatgcccagctgcatggcatgttctttaagcaaaaactgcaaactatgaaaatgagttagataatgtaagcatctatttctatgattttagaattttatttaaaaaaagtcaagggcctagaggtgttatcaagtgtaatcttctgccttgatctgaaagcagaaagctcaagtatctgtgacatctttgttacaaacc

SEQ ID NO: 1476 - DNA, 700 bp, Homo sapiens
accatgcccagctgcatggcatgttctttaagcaaaaactgcaaactatgaaaatgagttagataatgtaagcatctatttctatgattttagaattttatttaaaaaaagtcaagggcctagaggtgttatcaagtgtaatcttctgccttgatctgaaagcagaaagctcaagtatctgtgacatctttgttacaaacctgtgcacagtgaaggatccagccttgttccccaaggatgccatattcctgattctttaaaacttcattcctcttcctgatttccaatgtaggctgtcctcacagagccttacctgaagccagatggcctgacccagcagctaagtctttgtgtatgctgtggtagggacttagttctatgaggggctactttcttaatgagactccttactatactggaatattcattctagcttaagctagaatctggtttgcaatactattatgtcattgattctgaaacatcttatggttataattgcattttttcattcctgctggcacataaaatagtggtatgtcttataactgatgagacagtgaccttattctgataaggagtgccatgaaaactctaacgggtcttcagcttcttgttctacatttagcctatcctgtgagaatgcttcaggcccttcttttaaaagtctacataatgttgcaggaaatgttggttagct

SEQ ID NO: 1477 - DNA, 700 bp, Homo sapiens
tgcattttttcattcctgctggcacataaaatagtggtatgtcttataactgatgagacagtgaccttattctgataaggagtgccatgaaaactctaacgggtcttcagcttcttgttctacatttagcctatcctgtgagaatgcttcaggcccttcttttaaaagtctacataatgttgcaggaaatgttggttagcttcaggagagtgtaataatagtagctgagcctgattcattttatatagcagcaaagagcttcccaccattcaggtgtagccttgggtgcttccactgcactgatgtttgtttctctctttcagttacttgggtgagttggctccccaggcttttgagatacctgccttttgtccagcactgcatcgtcctcgcatatccaaggctgtgtctcccttcagcatcaccactcggtagttataattccgccttttatcagaagctgatacattttcatcggcatcagaccgtatttctatgtattcaatatctgacacaggaagaagaatattttagaggaacctatgctctgtagccttttgtcatttacaaacatatcaagtaagcctaggaacaacagatgaggctgacattaccagaggaaaacaatggctggtgtggaaactctttctctggctgggaggattcaagagcctggtggtctggccagaagcaacccaga

SEQ ID NO: 1478 - DNA, 700 bp, Homo sapiens
attcaatatctgacacaggaagaagaatattttagaggaacctatgctctgtagccttttgtcatttacaaacatatcaagtaagcctaggaacaacagatgaggctgacattaccagaggaaaacaatggctggtgtggaaactctttctctggctgggaggattcaagagcctggtggtctggccagaagcaacccagatgccccagttcctcagcctcaactctttcttagtttccctgttaagagtttcctccaggccaggcgcggtggctcacgcctgtaaacccaacactgggaggccaaggtgggcagatcacctgagggcaggagtttgagaccagcctggccaacatggtgaaaccccatctctactaagaatacaaaaaattagccaggtgtgggagcgcgcacctgtaattccagctactactcgggaggctgaggtgggagaatcacctgaacccaggaggtggaggttgcagtgagccaagattgcaccactgcgctccagcccgggtgacagagaagtgcgagactccatctggaaaaaaaaaaaagaaaaagaaaaaaaaaagagtttcctctggatggtttttcttattgcattttggcttatccctatctacactatgacagaacctattatgtcatcagctaaatataatgcctactgcagtcaaatatgtaagtcctgtta

SEQ ID NO: 1479 - DNA, 700 bp, Homo sapiens
accactgcgctccagcccgggtgacagagaagtgcgagactccatctggaaaaaaaaaaaagaaaaagaaaaaaaaaagagtttcctctggatggtttttcttattgcattttggcttatccctatctacactatgacagaacctattatgtcatcagctaaatataatgcctactgcagtcaaatatgtaagtcctgttaggctctggaacagaaaactttacattttcttgctacaagatgttgccaagataagaattcttagaaaatctcaaagacatgcttagaaaggggtccagggaggtaatgctggcatgatgagaggtcataaggggaagagctgcggagagggctttggaaagagcatttgtgatacaccatggtactcaccttgtccacgataggtacttcgccacaggtcacgtataattttattgatttcttccattttcatactgtgaaatttcattattgctctggaaaaggaagtcattggtacttcatatatataaaaaataattatgtgtaatagtaatattaaaatacataaaatatataatatataaaaaatagaaatataaataacttcctcaatattttcaatggtaaaagtagaatatagtaagagctacaaaaataaacagcagcaaaactttgctgcttggctaatactgaaaattggcaggcttatttctagtgc

SEQ ID NO: 1480 - DNA, 700 bp, Homo sapiens
ttcatatatataaaaaataattatgtgtaatagtaatattaaaatacataaaatatataatatataaaaaatagaaatataaataacttcctcaatattttcaatggtaaaagtagaatatagtaagagctacaaaaataaacagcagcaaaactttgctgcttggctaatactgaaaattggcaggcttatttctagtgctccaggggtacccttctccatattcactctctaggatacaacaaatactcctttacgtaaatacttaaatactgtgaaaacttcaggaaacataattttttagacttttttcttaggccgtggtaacttattggagggaatgcttccactgatactcacgggtcacaggaaggcctgctgaatggacgacagggagttaaagggtagaaggtttacggttagccaaggggcctgcagtctatggggaaaataggagaatcgaactgccaccttgtccctcttctatcactgttaaggcttaccaaaagtcagcttcttatgttggttttattcctcagatcttagatttttaccaactggaagctttggttcagcgagaatgatttagaagcttaagctgaactgacatcaaaattttattttacctttccttcacagattcagaaatcctaattctaaatattaacttccatatttatattccaaatcctaactctaa

SEQ ID NO: 1481 - DNA, 700 bp, Homo sapiens
ttaccaaaagtcagcttcttatgttggttttattcctcagatcttagatttttaccaactggaagctttggttcagcgagaatgatttagaagcttaagctgaactgacatcaaaattttattttacctttccttcacagattcagaaatcctaattctaaatattaacttccatatttatattccaaatcctaactctaagcactaaattccacttagtccagacatgtccctgtcctcaactctcttttaaggtagtagtttctaaacactaaaaacaaagaggagaaatgtttgtaaaagcaaaagtagcctgtcaaaacctaacattgttcccaccacagtcacctttcatcaaaaagcccttaggttctttggaagcgggtttatgaactaataaatgttgcaccagtggtaaaaaggcaaacattactgcgatcatcatacaaaggatgtgaggatgtgaggcgacttacttccatttgcaggcctcttatctgatgcatacaaaaaaagaaactgaatataatgctactgcctctgtagaatcatttcgtgatcttctggttcaccagcaagagagaaagaaatgactcaacataaatacattttaaatatcagatgaaggactgtgaagtagtagaagactggaaaaaaccatattctgcttgttgatgagaatgcaacaagtctccatttt

SEQ ID NO: 1482 - DNA, 700 bp, Homo sapiens
gatgcatacaaaaaaagaaactgaatataatgctactgcctctgtagaatcatttcgtgatcttctggttcaccagcaagagagaaagaaatgactcaacataaatacattttaaatatcagatgaaggactgtgaagtagtagaagactggaaaaaaccatattctgcttgttgatgagaatgcaacaagtctccattttctaccttatacatttatctcagcctaacattttatgctcctttcaaaaggagacaaaacatctaagtatttcctaaaaacaaaacaaaactgatggaatgttagaccaatcatgtaaagactgcctttccatagcttatatatcatgatcctgatttttcaaatgacattaaaaaaaagttatctttccattcaagttaaaaatcttcaaaaactaacataagcattctaatgtggagaacaagctccagacaaggcaggggtggccaaggcgcacacgtgcagtctgccttggctcccttatacaacacaggtggtgcatcctgtcccatggccaggtctgctgagacacagcactgcgggaaaaagatctagttcagggagaggtctcaacccaccaaagagtgtgtcggatggagttgatgactaccactgtgggacggaccattaactcatcttcgtatcctctctgtctactatggaatttacagctgtactgt

SEQ ID NO: 1483 - DNA, 700 bp, Homo sapiens
cttatacaacacaggtggtgcatcctgtcccatggccaggtctgctgagacacagcactgcgggaaaaagatctagttcagggagaggtctcaacccaccaaagagtgtgtcggatggagttgatgactaccactgtgggacggaccattaactcatcttcgtatcctctctgtctactatggaatttacagctgtactgtgtaagagatggggatgactaaggtcgctacagtaatctacataagggaataacaatgataataatgattattattgatgaccatttaccatatgcgagacaaaactatgctaaataatcaatttcatttaatccttacgacaatactgggaattagatactgttatctctatttaccattaacaaaactaagattcaatgaaatcagtgacttgttcaagatcagagaaaagtggctaggatattaacagcccttgaatatgacagttaaaattgaaaaggcagtcaaaattccatcttttaaagccaccagactcagttttatgagggaatgttatcaaatcttcaagacacacctagctcccaagtatataaggtatgacacagcaaggagaaacataaggggaaaaaagtacaaggctatttttcttatgaatataaacattctaaataaaacgaaatttagtagtaagggtagtaaaaagaatatatcatgacca

SEQ ID NO: 1484 - DNA, 700 bp, Homo sapiens
tttaaagccaccagactcagttttatgagggaatgttatcaaatcttcaagacacacctagctcccaagtatataaggtatgacacagcaaggagaaacataaggggaaaaaagtacaaggctatttttcttatgaatataaacattctaaataaaacgaaatttagtagtaagggtagtaaaaagaatatatcatgaccaagtagtgtttacaacaagaaagaaacagtaaaactggggaaaataattcaactaatatagtagcagattaaaaagaaaaaaataatttttcaatagatgtcataaaaacatttgatacactgtaacactgaattttgataaaatatcttaagtgaaaaatcaaagaatgttttcttaactggacaaaatgactccctcagatatccacagcaagcatcaaatttaatttaaaatctatagaagtgttcctcctaaaactaagaagagaaagatgcctcctattatggctgctctaaaataaggtcctggaaatccctaacgattcagggatttcacgattcaaatccctacctaaaaagaaatgagaaatgaaaaaaagagagaaaagcctgtcattatttttgcaggtgacagaattgtatgcttagaaaatccaagaaaatcaactgaaaaattattcagactaatgagatagccagagataaatatataaaaatga

SEQ ID NO: 1485 - DNA, 700 bp, Homo sapiens
taaggtcctggaaatccctaacgattcagggatttcacgattcaaatccctacctaaaaagaaatgagaaatgaaaaaaagagagaaaagcctgtcattatttttgcaggtgacagaattgtatgcttagaaaatccaagaaaatcaactgaaaaattattcagactaatgagatagccagagataaatatataaaaatgaagttttattatctagaggcaaacaccaataggaaaggcaatagaaaaaaaaaggatcctattcacagtggcgataaaaaccctaaaatgcctaggaataagtctaacaaaagggtataggagctagaggaaaaagctgtaaaactttacaataggataaaaggaaatgattgagcaggagatgcatactaaggagtccagaatggtagatgtgatattacaaagatgtccgttctcctcaaataatccataaattaaatgcaatccaaacagaaaccccaataaaattaaaaaatgcttaacagaatccataagctgactctaaagttcatatagaagagataatacaaaagaaaaaaaataaattttaaaagttggtatacaaaggaaaatccagaaacaaacccaaatgcatatagaacgttagtttataactgcaacagttcaaatcaactggaaagttttcaacagtgttacaaaagataaaaaaaaaattatta

SEQ ID NO: 1486 - DNA, 700 bp, Homo sapiens
taacagaatccataagctgactctaaagttcatatagaagagataatacaaaagaaaaaaaataaattttaaaagttggtatacaaaggaaaatccagaaacaaacccaaatgcatatagaacgttagtttataactgcaacagttcaaatcaactggaaagttttcaacagtgttacaaaagataaaaaaaaaattattacccgttatccaacctcaaaataaaatccaaatgaatgaaaggattaaaagctaaagtatttgggcagctgaggtgggaggattgcttgagcctggagtttgagaccagcctgggcaacatagtgagatcccatctctacaaaaaaatttaaaaattagctgggtgtggtggtgagtgcctgtagtcccagctacttgggaggctgaggtgagaggatcaactgagcccgggaagttgaagctacagtaagctgtgatcatgccactgcactccagcctcggtgacagagtaagaccctgtctgaaaaaacaaaaaacaaaaaacaaaagctaaggtaaaataaaacaatcagatgaaaacattttgataattttaggattgggaagcctttctaaataaggaacaaaattgagaagccataaatcaaaagactaaagatttgactacctaaaaattaaaagttacaaaagataccataaagaaagctgaggcagctggg

SEQ ID NO: 1487 - DNA, 700 bp, Homo sapiens
gtctgaaaaaacaaaaaacaaaaaacaaaagctaaggtaaaataaaacaatcagatgaaaacattttgataattttaggattgggaagcctttctaaataaggaacaaaattgagaagccataaatcaaaagactaaagatttgactacctaaaaattaaaagttacaaaagataccataaagaaagctgaggcagctgggtgcggtggctcacacctgtaatcccaacactttaggaggccaaggcaggcagatcacttgaggtcaggagtttgagaccagcctgaccaacatggtgtaaccctgtctctactaaagatacaagaattagccaggcgtggtggtacatgcctgtagtcccagctactcgggaggctgaggcaggagaatcgcttcaacccgggagatggaggcggaaggaagtaagctgagattgtgccactgcactccagcctggacgacagagctagactctgtctcaaaaaaaaaaaaaaaaaaaagaaaaaacgaaagaaaattgatggacaaacgataaactgggaataggtacttgcaatgtatgtgaaaataattaacatctagaatctattaaaatgtgacaaatcaagaaacagacaacctagtagaaaaactggcaaagagatatgaataggtaattcttggagaagaaatacaaatagacaacatacaaaaagacatt

SEQ ID NO: 1488 - DNA, 700 bp, Homo sapiens
agaaaaaacgaaagaaaattgatggacaaacgataaactgggaataggtacttgcaatgtatgtgaaaataattaacatctagaatctattaaaatgtgacaaatcaagaaacagacaacctagtagaaaaactggcaaagagatatgaataggtaattcttggagaagaaatacaaatagacaacatacaaaaagacatttaacttcactagtaaagagggaaatgtaaattaaagtgcaagctttttttgtgcagccaataaaatgtcagtaacaaaatccagacatggaatgggcactttcatatactattggtggaaattttctaagtgtttttagaaggcaatttggcattaactaaaaaatatacataacatctgagccagtaactccatttctaggaagctgtctttttgacatatctgctttagtgtgcaaagacacactctgcagcattatctgtagtagcacatatttaaaagctttctaatatgttcaatagtggttaaataaagtagatatcatgcattttacagaatatgcagccattaaaaatacaaggtacttgaatatatgaacgtaaaagattatcaccacgttaaatggaaaaaaaaactcagaaaaatatctaccttgtgataatgcttacaaagaacaaaaaagatgtatttgggtgtactatgtgcaaagccattgtga

SEQ ID NO: 1489 - DNA, 700 bp, Homo sapiens
atagtggttaaataaagtagatatcatgcattttacagaatatgcagccattaaaaatacaaggtacttgaatatatgaacgtaaaagattatcaccacgttaaatggaaaaaaaaactcagaaaaatatctaccttgtgataatgcttacaaagaacaaaaaagatgtatttgggtgtactatgtgcaaagccattgtgagggaaatgaaaatatgtcaccaacttaataattcttaagggctgaatcaaagttagacactgtcatggaaatgagcctaagtctaccttgaagtgtgttctgtggtttgcagttatggagcgtggggaagcccaaatatctgtaatacaaggctgaatggctttagttgtataagtggtacaaaatattattaagtacaaaggtaggaaaaaaatcacatatgtttgggaagggcttaatcaacataacattccaaggatgggagagatagcacaggaaaatatgggacaaaattgtttggttagaacacacttggtagtaggaattgaaatgggaaagcccaggtatggaagtcattcctaaaattagaagggaatagggaccaccagctttaggaaaatgaagctggcagaagtataatgggtggaggtgggggtaggaaggacggtaagagataagaggtgggaaaggtgccacggtaataggtgagagttactta

SEQ ID NO: 1490 - DNA, 700 bp, Homo sapiens
tggttagaacacacttggtagtaggaattgaaatgggaaagcccaggtatggaagtcattcctaaaattagaagggaatagggaccaccagctttaggaaaatgaagctggcagaagtataatgggtggaggtgggggtaggaaggacggtaagagataagaggtgggaaaggtgccacggtaataggtgagagttacttaggctgaagccatggaaagaaggcagctctgggctgggtgcggtggctcacacctgcaatcccagcactttgggaagctaaggtgggaggatagcttgatcccaggaagtcaaggctgcagtgagctgtgatcatagcactgcactccagcctgggtgacagagtgagatcctgtacaagaaccctataggagctattgagtgacatatagtggcccaattaacttaacacgcttttatcacttggactttacaggcatttaacatcaaataacttacagaatgaccttgaaagtccatgactgtctggtgaggcaaagatttgaatttcatgggctgcaaactgttatggtcaagtagccatctggctagtgtatcagctccaccacctgcctggagtatgcacatctctcagttaaatgcatatactaactcatgcgaagtagtatgatttctttgtgaaaactggctcttaaagtgagaggccaggtgaggtggctc

SEQ ID NO: 1491 - DNA, 700 bp, Homo sapiens
gactgtctggtgaggcaaagatttgaatttcatgggctgcaaactgttatggtcaagtagccatctggctagtgtatcagctccaccacctgcctggagtatgcacatctctcagttaaatgcatatactaactcatgcgaagtagtatgatttctttgtgaaaactggctcttaaagtgagaggccaggtgaggtggctcacgcctgtaatcccagcactttgggaggccaaggtgggtaaatcacttgaggtcagatgttagagaccaccctggccaacatggtaaaactctatctctactaaaaatacaaaaattagccggtgtggtggtgggcacctgtaatcccagctatttgggaggctgaggcaggaggatcgcttgaacctgggaggtggaggttacagtgagccgagtttgcaagaatgaactccagcctgggtgacagagccagactctgtcttaaaaaaaaaaaaaaaaaaaagtgagactctctcggagctcagaaaataatgatttataaattactttagtctgatatttaaatactcattaagagtctgaaagatttcattaaaaatttcagtaacaatcgattgcattttatgaggaaaaatgatggctttaatggcatttatatttctggtaatccatgaaagtcttaacaagcttgtccagcctgccttattttgttgttctg

SEQ ID NO: 1492 - DNA, 700 bp, Homo sapiens
agctcagaaaataatgatttataaattactttagtctgatatttaaatactcattaagagtctgaaagatttcattaaaaatttcagtaacaatcgattgcattttatgaggaaaaatgatggctttaatggcatttatatttctggtaatccatgaaagtcttaacaagcttgtccagcctgccttattttgttgttctgttttgttctaggcttttagcagactgaagccatggtttttagttttgtctctagtgatgagcagaaaagagggatgaggaagaggctttactggtccaaccagaaagagaagctaagaacccatgactggattctctcccttggacaccccacagaccaatatctcaccttccaggagaagacccttccagctcttgcttctttaaacctattaacttagttttctttagctagactcccaaacatcagcttttacaattcagcctatggttcaatcactatggcaagataaacatttgtttaggtgtgaaacaccactggctatctttgggttttgtaatctaccctcttgaggttgcaggagctactgtgaaaccttactgcatccatggtcatgatagagatggtgactctaaggtgagccctgaataaagccctcatctgaagctcccctcgaatgcagggacccaggctctgaagagcctcacagaaagctggc

SEQ ID NO: 1493 - DNA, 700 bp, Homo sapiens
gtttaggtgtgaaacaccactggctatctttgggttttgtaatctaccctcttgaggttgcaggagctactgtgaaaccttactgcatccatggtcatgatagagatggtgactctaaggtgagccctgaataaagccctcatctgaagctcccctcgaatgcagggacccaggctctgaagagcctcacagaaagctggctaccttggatgcaaaactgtaaaggttacgtgtttacaatgagtcttaaaagaagcatgacctggccaggtgcgtggctcatgcttgtaatcccagcactttgggaggccaaggcaggtggatcacaaggtcaagagatcaagaccatcctggccaacatggtgaaaccccgtctctactaaaaatacaaaaaattagccgggtgtggtggcaggcgcctgtaatcccagctacttgggaggccgaggcagaagaattgcttgaacccgggaggtggagatggcagtgagctgagatcgcaccattggagtccagcctgggcaaaaagagcgaaactctgtctcaaaaaaaaaaaaaaaagtattacctaatatgcaaccttccacatctggggaaaaatgagagtagaacattttgggcatggggtagaacaccatatcttgagtgatatattctaacatcatttaaattggtatattgtattagtatggggtaatac

SEQ ID NO: 1494 - DNA, 700 bp, Homo sapiens
gcaccattggagtccagcctgggcaaaaagagcgaaactctgtctcaaaaaaaaaaaaaaaagtattacctaatatgcaaccttccacatctggggaaaaatgagagtagaacattttgggcatggggtagaacaccatatcttgagtgatatattctaacatcatttaaattggtatattgtattagtatggggtaatacattccaaatgatggataatttcccccttttcatctatgtgtctctgaccactgccaatgcttatacttagtgatgtttttagatgattactaataacagatggtaatcagcttttcttgaaaatgcactgctgacttcctgtgttaccttaaatagacagctgaacgcaacaattacactgactgcatgctttattctaagacgtgaaagaatgagggaaattttgtaccttactttcttctgggtgagaaggcaaatttagggctcaccgtataaatcttgagaaggccactgtttgcgagcataagccacaaagactcaattttggggaaatttgtatcacctcttttcatttagaagaatccatctgagtaccaggtaagagaactcagtaaacagcctggctttgttccttaacaagcctaaattgctagaaagcactcctgtacctctccaccccgccaggctccaccaagctccctcataggtcctcattctg

SEQ ID NO: 1495 - DNA, 700 bp, Homo sapiens
cgagcataagccacaaagactcaattttggggaaatttgtatcacctcttttcatttagaagaatccatctgagtaccaggtaagagaactcagtaaacagcctggctttgttccttaacaagcctaaattgctagaaagcactcctgtacctctccaccccgccaggctccaccaagctccctcataggtcctcattctgctcagcatgcctctgtgactgaggcacttttctctgctgaaaagcccttccttcttatcccaggcccaggtcaaaaacagactatggagcacctaccaaggtctccatcagacagactgtcagcagtttggaggagggacagggaaagatattcctgttttcccagagcctgacaagaaagtggcagagcaagggttgttgaattcttttttattttttctcttatagcctaatcttggaagtgaagggaattcttattcctgctgccactggttctcagggtatgcagggatagctggagagctcctacgtatgtttttctattcagtgaatacatatgaaaccccaggtctgcaggtcaatgggctgtaagagaagagctgaccttgcagcaaaatacttacaagtaaaattgaaaacaaaaccaacctgcctatttaacttggtccctggtccactctaaccattgccccatttttcttgctccccgtcacaggag

SEQ ID NO: 1496 - DNA, 700 bp, Homo sapiens
gagagctcctacgtatgtttttctattcagtgaatacatatgaaaccccaggtctgcaggtcaatgggctgtaagagaagagctgaccttgcagcaaaatacttacaagtaaaattgaaaacaaaaccaacctgcctatttaacttggtccctggtccactctaaccattgccccatttttcttgctccccgtcacaggagaagttgttataagaattatctatattctctgtctccatttctttttcttttttttttctgagacagtttttttctcttgttgcccaggctggagtacaatggcacgatcttggctcactgcaacctccgcctcccgggttcaggcgattctcctgcctcagcctcctgagtagctgggattacaggctaggcaccaccaggcccagctaatttttgcatttttagtagagacgtggtttccccatgttggtcaggctggtctcgaactcctgacttcaggtgatccacccgccctggcctcccaaagtgctgggattacaggtgtgagccaccgtgcccggctgctgtctccatttcttactacccattctctccccacccaacttgaccgggcttcagttccaactgtgccactgactgctcctcagtcattaacaacttccattttgtcaaatttaagggccacttcttagtccttatcttatttgactccaaatag

SEQ ID NO: 1497 - DNA, 700 bp, Homo sapiens
ctcccaaagtgctgggattacaggtgtgagccaccgtgcccggctgctgtctccatttcttactacccattctctccccacccaacttgaccgggcttcagttccaactgtgccactgactgctcctcagtcattaacaacttccattttgtcaaatttaagggccacttcttagtccttatcttatttgactccaaatagcattagattcttgatatatttgcttcacttggttttcaagataccacatcttttaaaatcttttcccacatcaccagctgcttatttactggatttgcaaacataactagtggtgggacctttcccttctctctctatgctcattccacatgtgatctcatctcatgggttaaatgccgtggatatgctgatgactccccagtgtacacctttcacttgaactctaggctcgaggttatatatccaactgcctgcttgacagctctgcttagatatctacaggcacttcaaacttaaagtgtacaaaacggaactactgattttctctccccagtcccacccattttagggaatggcaacctgttctcccaatatcctgttgttcaagcaaaaatatgtaggagcaacctttggttattttactttccctcccttacactcaattcagaagcaaggcctgtcaactctctctccagaacaaatcccaagtctatcactt

SEQ ID NO: 1498 - DNA, 700 bp, Homo sapiens
gtgtacaaaacggaactactgattttctctccccagtcccacccattttagggaatggcaacctgttctcccaatatcctgttgttcaagcaaaaatatgtaggagcaacctttggttattttactttccctcccttacactcaattcagaagcaaggcctgtcaactctctctccagaacaaatcccaagtctatcacttctctccattttcactgctaccacctgatctagcccaccaccatctcttggttactacaagtctcctcatcagtctctgcttttactcttgccctttacaatccattctccacacccagcagccagtgcaatttcttccaactagaaatcagattatattacttccctgcttcaaaccctccagtgactgcccaatgcagttagaatgaaataaaactgtttgtttaccaaggctacaaggcatgacatactctgggaatggtctatccctgactatattccacccatgcttgccttcttcctggtccttgaacactttctgttcgtactggtcttggctgctgcagtaactattctctctacctggaacgcctgcaccccattttttgcatatcttgctcccttctcatcaatcaggtcccagcttaaaggcccatctgttatgctcacattgttcattttcactgtaatacctaccactactacccattttgttatta

SEQ ID NO: 1499 - DNA, 700 bp, Homo sapiens
tcctggtccttgaacactttctgttcgtactggtcttggctgctgcagtaactattctctctacctggaacgcctgcaccccattttttgcatatcttgctcccttctcatcaatcaggtcccagcttaaaggcccatctgttatgctcacattgttcattttcactgtaatacctaccactactacccattttgttattaatttatttcttaattttgtttcttcatccttatatacttagtatctagaacagtatcaagcatttatgtactcaaatttttattgaacaaaatcctaatatacaactatgtattatgtacacaagcacctcactgaagagttacaaaatatatagaaataagttatggttctaaaccaggaagtataagtaacagttaaaatgcttttatataaatactagttttttaacggttataaaaaaaggtcatgcccgtaatcccagcactttgggaggctgaggagggtggatcacttgaggccaggagttcaaaactagcctggtcatcatggcgaaacctcgtttctactaaaaatacaaaaattagcccagtgtggtagcacatgcctgtaatcccagctacttagaaggctgaggcatgagaatcgcttgaacccaagaggcagaggttacagtgagcagagatcacgccactgcactccagcctgagagagctgaga

SEQ ID NO: 1500 - DNA, 700 bp, Homo sapiens
gccaggagttcaaaactagcctggtcatcatggcgaaacctcgtttctactaaaaatacaaaaattagcccagtgtggtagcacatgcctgtaatcccagctacttagaaggctgaggcatgagaatcgcttgaacccaagaggcagaggttacagtgagcagagatcacgccactgcactccagcctgagagagctgagagaaccagtgagactccgtctccagaaaaataaaaaaaaaagcagggggccactatggtagcagcatgtcacagtggttctgatatctaattttatctctaccatttacctgggtaatcttgggtagcctgcttaatctgtctgataaatacttgccctttaaaacagagttagatacaataattaaatcgattatgctatcatgtagtattcaattgctattattgtcttctatgcacagccctcaacctcaaagaatgtttaaatgggaacagaaacctacgttttcttaatgaatttagttctttagtgctattaaagaatagagaatttaagaacttaacttacattaaagaatggaacatgacaaaggaagctggactaaatcgcctctgagcttttctgactctatactgaataatagtatagatttttaaaaattctattttatagatgaggaaacggaaactcagagtgtctaaataatttgctaaatatct

SEQ ID NO: 1501 - DNA, 700 bp, Homo sapiens
tagttctttagtgctattaaagaatagagaatttaagaacttaacttacattaaagaatggaacatgacaaaggaagctggactaaatcgcctctgagcttttctgactctatactgaataatagtatagatttttaaaaattctattttatagatgaggaaacggaaactcagagtgtctaaataatttgctaaatatcttcagtcaggactcaaaatcaccactatggagaatagtatggaggttcctaaaaaaactaaagacagaactaccatatgattctgcaatcccacttactggatatttacgcaaaggaaatgaaatcattaggttgaggagatatctgcactcccatatttattgcagcactgttcataatacctaagatttggaagcaacctaagtgtccatcaacagataaatggataaagaaaatgtggttcctctcgggcgcggtggctcacgtctaattccagcactgtgggaggctgaggcgggtggatcatttgaggtcaggagttcgagatcaatatggcctacatggcaaaaccctgtttctactaaaaatacaaaaattagccaggtgtggtggcaggaacctgtaattccagctactcggaggctgaggtggaggttgcagtgagctgaaatcacaccactgcacttcagcctgggagacagagactccgtctcaaaaaa

SEQ ID NO: 1502 - DNA, 700 bp, Homo sapiens
tggatcatttgaggtcaggagttcgagatcaatatggcctacatggcaaaaccctgtttctactaaaaatacaaaaattagccaggtgtggtggcaggaacctgtaattccagctactcggaggctgaggtggaggttgcagtgagctgaaatcacaccactgcacttcagcctgggagacagagactccgtctcaaaaaaaaaaaaaagttgttcatatatacaatggagtgctattcagccataaaataaaatgagatcctgtcatctggaataacatggatggaactgaaggacattatgttaggtgaaataagccaggcacagaaagacaaactttgcatgttctcattcatttgtgggagtgaaaaattaaaacaattgaactcatggagatagtggagatgatagttaccagagactaggaagggcagtggagatggttaacaagtacaaaaatatagtaagaataagatctagtatattatagcacaacagagtgactacagtcaacaatgtattgtacatttaaaaataactaaatagtataattggaatgtctgtaacaaaaggaaggataaatgcttgaggtgatggaaacctcatttaccctgatgtgattattatgcattgtatgcctgcatcaaaatatctcacgtaccacataaatataccggctatatagccataaaaaataaga

SEQ ID NO: 1503 - DNA, 700 bp, Homo sapiens
gtgactacagtcaacaatgtattgtacatttaaaaataactaaatagtataattggaatgtctgtaacaaaaggaaggataaatgcttgaggtgatggaaacctcatttaccctgatgtgattattatgcattgtatgcctgcatcaaaatatctcacgtaccacataaatataccggctatatagccataaaaaataagaataaaactttttttaaaaaaaagaattcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaattcaaaatctggacatctgtagtgttcagagacagcacttttaaccatgtattatggacttctgaggctttttaaaaaaggtaaaacttatcatgttggacttttatacaaagtccaatgtcttgcttttaatatccatttttatttttccatcacaaccaacttatcttat

SEQ ID NO: 1504 - DNA, 700 bp, Homo sapiens
gactccgtctcaaaaaaaaaaaaaaagaattcaaaatctggacatctgtagtgttcagagacagcacttttaaccatgtattatggacttctgaggctttttaaaaaaggtaaaacttatcatgttggacttttatacaaagtccaatgtcttgcttttaatatccatttttatttttccatcacaaccaacttatcttattccaaatagaagttttggtgattttttttttttttttttttttgagacagggtctctttctgtcacccacgctggagtgcactggcacaatcttggctcattgcaacccgccacgggcttctgagtagctgggattacaggtgtgtgctaccacgcccagataatttttgtatttttttgtagtgatggggtttcgccatgttgcccaggttggtctcaaactcctggacttaagcaatccacccactttggactcccaaagtgctaggattacaggcgtaagccactaagcctggcaaaataggtttttaccaacaaaaatctgttttgatttgtgtctcttcaaataaactataatatccttgctagaagttactggatctcctattccttaatgctcaatgaatgtttgataagtctattagatacacagcatctgttgttaaagaactaagaaaaactaaaaagtcccctaaaggcataaatgaggtagctgaga

SEQ ID NO: 1505 - DNA, 700 bp, Homo sapiens
aaataggtttttaccaacaaaaatctgttttgatttgtgtctcttcaaataaactataatatccttgctagaagttactggatctcctattccttaatgctcaatgaatgtttgataagtctattagatacacagcatctgttgttaaagaactaagaaaaactaaaaagtcccctaaaggcataaatgaggtagctgagaagactaaaaagaattattaaaggcaaaaaaaaccaaaaaacaaaaaacaaatatatgtatgtgtagtctactgggcaagaattccttaagttttgcttatgttcttgtttcagcaccttaaattccaagactaaccactttaaactgctggatctaatatctaggagagatggcaatattcaaagaagttaaaaaacaaaagttctcatttggtgcaggcatataattctatgagccattttggacccagggaacattgtaatgttaacgtacccactcacaatgaaatgggacaaaagatatatccatggaatactctcaaaaaattgttttaaaagttaaacttaatctaacaaaaatcttagtataatttatttttaaaaaataacatgttaattggctcactcccaatatttcacagtaaatggatctaatttgtcttacatgattacgtacttcctaaaacttgtatatgccaaaaatatgcctaggcaattct

SEQ ID NO: 1506 - DNA, 700 bp, Homo sapiens
gatatatccatggaatactctcaaaaaattgttttaaaagttaaacttaatctaacaaaaatcttagtataatttatttttaaaaaataacatgttaattggctcactcccaatatttcacagtaaatggatctaatttgtcttacatgattacgtacttcctaaaacttgtatatgccaaaaatatgcctaggcaattctgggaccacctttgttatcatcactaactaaaaaagtcctcatactgaaaccagagttctcctgtcttcctgagccctgtggtctgaatgccactgctcaggttggtctgttgactatgctgtatctgaccagaagtcttagaagagaagctctctgtgtaactctcttagtgctaaggaagatatttgccattctggaaaaaacaaccaccaccaaaatctaaggtaagtaataattctcctgccacaaatgaacagaactactagatagacttataacaaaacttattttaaattcatagttgagctcacaagaaagaaagggaaatccctacataatagaaacgaagatagaagtgaaaaccagaccagtcagtatgtaacctgacagacaaactaaacttggggttattattattactgttattgttagttttgagacagagtctcgttctgttgcccaggctggagtgcagtggtgcaatcttggctcactgcaa

SEQ ID NO: 1507 - DNA, 700 bp, Homo sapiens
tagttgagctcacaagaaagaaagggaaatccctacataatagaaacgaagatagaagtgaaaaccagaccagtcagtatgtaacctgacagacaaactaaacttggggttattattattactgttattgttagttttgagacagagtctcgttctgttgcccaggctggagtgcagtggtgcaatcttggctcactgcaacctctacttcccagttcaagcgattctcctgcctcagcctcctgagtagctggcattacaggtgtgcaccactacagccagctaatttttgtattttttttagtacagacggggtttcaccatgttggccaggctggtcttgaactcctcacctcaagtgatccgcccacctcggtctcccaaagtgctgggcttacaggcatgagccaccgtgcccagccatgaacttggcgttattgtttttataacctagggattggttcttatcatccaggacagaagatgaaggataggacccaagtaaggaagaagattagaagtgactcccaacacacaaaaaatgggactcttcaagagctataacatcaatcctcaatgaaagagtggaaaattaatgagttgaaaattcaaagtcttgggcaaatgctttatatagttttggggttcaaagttatgctaccagtgagtatagtctaggaacctaccaactaagaaatta

SEQ ID NO: 1508 - DNA, 700 bp, Homo sapiens
aagtaaggaagaagattagaagtgactcccaacacacaaaaaatgggactcttcaagagctataacatcaatcctcaatgaaagagtggaaaattaatgagttgaaaattcaaagtcttgggcaaatgctttatatagttttggggttcaaagttatgctaccagtgagtatagtctaggaacctaccaactaagaaattaacaaaaaccctacatgcaggccaatgttttctctggagctcttagttaatataaaaccaaaatttctgtgtagatggacctctacaaggaaaggtcacaagggagtctcatagaaaaaacaacactactaaagataagcacacaattaaatgttaataaaacacagaaacttcactaggggatagaatcaacatacaaaacagcagaagcagactcctcaaaatgtgaaattaaaaaataacaatctgaaagagaatataaaatgtgtatagttaaaatgagtaaagacacattcaagaaggaatcaaaatactaaggaagaaaatacatcataagcctggcacagtggctcacatctgtaatcctagcactttgggaggcctaggtataaaatgtgtataaaatgagtaaagacacattcaagaaggaatcaaaatacaaaggaagaaaatacatcataggcctggcgcagtggctcgcatctgtaatcctagcattt

SEQ ID NO: 1509 - DNA, 700 bp, Homo sapiens
aaggaatcaaaatactaaggaagaaaatacatcataagcctggcacagtggctcacatctgtaatcctagcactttgggaggcctaggtataaaatgtgtataaaatgagtaaagacacattcaagaaggaatcaaaatacaaaggaagaaaatacatcataggcctggcgcagtggctcgcatctgtaatcctagcattttgggagacctaggcaggaggatcgcttgaggccaggagttcaagaccagccggggcaacatgacaaaaccccatctgtaataaaaatacaaaaattagccgagtggtggcatgcatctgtaattccagctatctgggaggctgaggaatgagaactgcttgaactcaggaggtggaggctgcagtgagccgagatcatgccactgcactctagcctgggcgacagagccagactctgttttaaaaaaaaaaaattataaaaaaaccatgtgagtttctgaaaaagaacaaaatagaacttatagaaaaaaatggaggaaaaaatgacaactcaataggcagtataagtagcagctaaataatttatttaacaagatatttacccagagcccagtatatgcaagaggggttaagcaatgtagaggaaagaggaggttatgtctaataaaaagtgaagaaggggaaaatagtgagaaatggagaaagaataatatttgaag

SEQ ID NO: 1510 - DNA, 700 bp, Homo sapiens
ttatagaaaaaaatggaggaaaaaatgacaactcaataggcagtataagtagcagctaaataatttatttaacaagatatttacccagagcccagtatatgcaagaggggttaagcaatgtagaggaaagaggaggttatgtctaataaaaagtgaagaaggggaaaatagtgagaaatggagaaagaataatatttgaagagataatgtatgaaaaatccccaaaattgatggaagatatcaatcctcagatcaaaaagcataatttatgagcagaagaactaaagctgagtctagacacactattataaaaatacagaacactgaagacaaagggaaaaatcctaagagaaccaggggaaaaaggcagattacttttaaaggaataattaaaatgatttctcaactgtaaccatagaggccaacaaaaaatgaaatattttcaaagtgccaagagaacaaaactgtcaatctagaactctatgctcagctaaactatcaaattaaggggaaaaacttctcaaagactgattgtttaccactaacagtcattcactgaaaaaactattgaagaatatactccaaaaaaagaaaactgaacctaaagaagggaggagtgggatttaaaaagcaagaatgaacaaagaaattgggaaacatgcgggcttatgaaaccaccacaataattattactcatttg

SEQ ID NO: 1511 - DNA, 700 bp, Homo sapiens
caaattaaggggaaaaacttctcaaagactgattgtttaccactaacagtcattcactgaaaaaactattgaagaatatactccaaaaaaagaaaactgaacctaaagaagggaggagtgggatttaaaaagcaagaatgaacaaagaaattgggaaacatgcgggcttatgaaaccaccacaataattattactcatttgtgatgatttaaaaacaaggtaaaactaaaatattagacaaaagaaataatgcagatgagagaagataattagtattcaggaaaaagataaaacaattcacattaaagctatggtttttaaactttgatgtgcatcagaatcacccaaaatgtctgtcaaaaatagactgctgggccctacctctcaaatttttgatcgaggtctggggtagaagctgagaggcatttctaacatgttccaaggtgatactgataatggtgctccacgaccactttgagaactaatgcatatgattttaagtcaaataagtatttaaaaattaaaaagtaaacactcaaataactaaagtagaatacaaccgatccttgaacacaggtttgaaccatgtgggtctatgtttatgtagattttcttccacctctgccatccgagacagcaagactgacccctcctcttcttcctcctcctcttcaatgtgaagaggacaaggatgaagacc

SEQ ID NO: 1512 - DNA, 700 bp, Homo sapiens
agtcaaataagtatttaaaaattaaaaagtaaacactcaaataactaaagtagaatacaaccgatccttgaacacaggtttgaaccatgtgggtctatgtttatgtagattttcttccacctctgccatccgagacagcaagactgacccctcctcttcttcctcctcctcttcaatgtgaagaggacaaggatgaagacctttatgatgattcatttccacttaacagaaaatatattttcccttataattttttcttgtctccagtttactttattgtgaaagaatactgcatataatacacataacatacaaaatatatgttaatcaactgtttctgttatcagtaaggcttccagtcaacagtaggctattagtagttaagttctgagggaatcaaaagttatatgtggatttctgactgcgtggggggcttagtgtccctaatccccatgttatatggtcaactggataacccaaagaagggaaaaaggaggagtcaagaaaaataaatccatctcaaaaaggcaggaaaggaaaaaaagatggcagaaataaatccaactcaattgagtaatcagaatgaatatgaaaggcctaaattcactggttaaaagacagacatacactggataaagaaaattctgctatatgtaattaagatggtgagagaaatggcacagagatagacaaagtgatg

SEQ ID NO: 1513 - DNA, 700 bp, Homo sapiens
tcaagaaaaataaatccatctcaaaaaggcaggaaaggaaaaaaagatggcagaaataaatccaactcaattgagtaatcagaatgaatatgaaaggcctaaattcactggttaaaagacagacatacactggataaagaaaattctgctatatgtaattaagatggtgagagaaatggcacagagatagacaaagtgatgaattaagtagaacagagaacccaggccaacccaggcacatagggaattctgatatatgacagaaatgacactgtaggtcactgagagaaggatagtctacaataaatagagccaagacaaccagttattcataacggaaaaaattcaacttagaattaaatacttaaatgtacttacatgtgaaaggcaaaatttaaaacttttagacaaaaatatagaagtagggcgtggcagctcacgcctgtaatcccagcactttgggaggccaatacaggtggatcacgaggtcaggaaatcgagaccatcctggctaacacggtgaaaccccatctctactaaaaatgcaataaaattagccgggcgtagtggcgggcgcctgtagtcccagctactcaggaggctgaggcaggagaatggcgtgaacctgggaggcagagcttgcagtgagccgagatggcgccactgcactccagcctgggcgactgagtgagactccgtc

SEQ ID NO: 1514 - DNA, 700 bp, Homo sapiens
agaccatcctggctaacacggtgaaaccccatctctactaaaaatgcaataaaattagccgggcgtagtggcgggcgcctgtagtcccagctactcaggaggctgaggcaggagaatggcgtgaacctgggaggcagagcttgcagtgagccgagatggcgccactgcactccagcctgggcgactgagtgagactccgtctcaaaaaaaaaaaagatatatctctctctctctctctctatatatatatatatctttatatatatatatctttatatatatatatatagagagagagagagagagagaggagtagagagagagagagagagagagagagaggagtagggaaggatttcttaacaagacacacaaagagctaaccagaaaaggctgctaaattcaactaactcaaaatcaaatccagtgtcatcaaaagatgctaagtaaaaaagataagcataatgtttgaaaagacatttgtaatacatataactgaaaaggaattgaaatgcagaagagataaagaacacatttaaatcaataagaaaagaccaatagggccaggaacaatgcctcacacctgtgaccccagcactttgggaggccgaagtgggaggaatgcctgagcccaggagtttgaggttacactgaactatgattgcaccattgcactctagcctaggtgacaaagagagac

SEQ ID NO: 1515 - DNA, 700 bp, Homo sapiens
aaaggaattgaaatgcagaagagataaagaacacatttaaatcaataagaaaagaccaatagggccaggaacaatgcctcacacctgtgaccccagcactttgggaggccgaagtgggaggaatgcctgagcccaggagtttgaggttacactgaactatgattgcaccattgcactctagcctaggtgacaaagagagactctgtcccaaaacacacaaaaagacaagactaataatgtataaacaacgattcatcattttaaacctatgaggttggcaaacattaagaaatttataaaaccaatgtcagaggatccatcaaataaacccttatatactgctagtggtataaatcagtagtcatttctggaaaacaatattattttgtaaaattgagcatactccacaatgcactcccacaaatataaccttatacctttcctccagaagacatgacaagacctggaaaaaaaccccaaatgtccatctgtaggagaatgaatgcattgtggtctattcccatagtagattatgtacatcagtgaaaatgaatcaactacggccataaacaacatggataaacaaaagcaaatccaaataaaaaagcaagtcctagaatatcatatcatttttaaaaagctcaaaatatgacatatatatgataaaactgttttttaaaaaagcagagaaagtaaaaat

SEQ ID NO: 1516 - DNA, 700 bp, Homo sapiens
  misc_feature (1)...(700): n = A,T,C or G
tgaatgcattgtggtctattcccatagtagattatgtacatcagtgaaaatgaatcaactacggccataaacaacatggataaacaaaagcaaatccaaataaaaaagcaagtcctagaatatcatatcatttttaaaaagctcaaaatatgacatatatatgataaaactgttttttaaaaaagcagagaaagtaaaaatctttgtcactggttatagggaatggggatgacagaaggttgagataagaagggagcatctaagtggatgccaatcagtgataatggtagattggttagagggaggtagtatcatgaatactcgtagatattaatatgctttatatcttaacttcataacttaagctagtgtgtgtttacatacatacatacatatattttccaatccatggtatacataaaataccatatttaaagagaaaaaatgaggggctgggcgcagtggctcatgcctgtaatcccagcactttgggaggccgaggcgggtggatcacctcaggtcaggagttcgagaccagcctgancnacatggngaaaccnngtctctactaaaaatacaannattagcnnngcgtggtggcangcncctgtaatnccagntacttgggaggntgaggcagnnnaatcnnttgaacccgggaggcagaggttgcagtgagcngagatngtgccattgcact

SEQ ID NO: 1517 - DNA, 700 bp, Homo sapiens
  misc_feature (1)...(700): n = A,T,C or G
aggcgggtggatcacctcaggtcaggagttcgagaccagcctgancnacatggngaaaccnngtctctactaaaaatacaannattagcnnngcgtggtggcangcncctgtaatnccagntacttgggaggntgaggcagnnnaatcnnttgaacccgggaggcagaggttgcagtgagcngagatngtgccattgcactccagcctgggnaacaanagtgaaactctgtctcaaaaaannntaaaannnnnaagaaaaaaagaaaaanannnnanaanngnnnannaannnannttnnnnnatntnaantgcantannnaaatccccagtctaatacttactggtcaagagtcttataataaatatccagatccttgttcacaagttctgttgtcctcataacaatcatcatttctctatacttttcctcagcatcccgaaattgtggttctcgaagttctttcttaaaatgaataatttcttcttcataacctttctgtcgccctaatgccaaattatgatttctttttatattgtctatgttctcttccaacttctgatgttcactgtaaaaaagaaaaatgacaaatgaggaccattttttagcttttaacaacctgaagtggaaaagtcatagatttctttagataggttaagtatcattctccttagcaatcagtatattataacagagtctc

SEQ ID NO: 1518 - DNA, 700 bp, Homo sapiens
tgtcgccctaatgccaaattatgatttctttttatattgtctatgttctcttccaacttctgatgttcactgtaaaaaagaaaaatgacaaatgaggaccattttttagcttttaacaacctgaagtggaaaagtcatagatttctttagataggttaagtatcattctccttagcaatcagtatattataacagagtctctccttgcttattatttagggctttggtactaaagaaaacccctctcttccttccatatctctgccgcacataggttgctaaatagctaattttgtgtattacagaaccctcatagcatgtgatcactgataaagttcctggcctttagacgctaagtaaagcactctggtgattaatattacaaattcacaatcttctgattgtgaactgagaatgcacaattatcaacactaagaagttatggataacaggcttcatcatcattttgctcatgtcaaaggcacaatacgaattaaatcatatattaattttctgcagtaatacttattaaaaatttagattcctccatgaaaacaaaatttctcttgcacaagtgtaaaaaccataataatgaccaaaaaagtaaaatattcaaacttttctgatattttggcagattatacaaatttcaatgtatgctttaaaaatcttcatttatttattatcacttattaagcat

SEQ ID NO: 1519 - DNA, 700 bp, Homo sapiens
catatattaattttctgcagtaatacttattaaaaatttagattcctccatgaaaacaaaatttctcttgcacaagtgtaaaaaccataataatgaccaaaaaagtaaaatattcaaacttttctgatattttggcagattatacaaatttcaatgtatgctttaaaaatcttcatttatttattatcacttattaagcatcctcttatgtgtcaggcactactctcaagcttatgggcatccttacagagtcgactggattacaagtcttgttggcatttctgttatgtcctggttgaagaaacgtttgaaaaatagttgtacttagtaatgtgaatgaatgtaaaaagtactgttatgtaccaattacagaagaaattttttaaatatctggttttggtctttagtagccacgaatatattattttatatcaaaatttcttctagaagcattacttttccaacttgccatggagagtatcgtgtaaaagaactgaggcttgggaactaggatattagggtcacattcttggctttcatcataatttcctctgtgatttttctgggtctaagtgtgcataatgcatacaaaaatgaagactctgaagatgatgagctcttctagttaaaaatctgatttccctgatataggaaagagattttaaatagctaagagtacttaaccaaaacacaggattaa

SEQ ID NO: 1520 - DNA, 700 bp, Homo sapiens
cttgggaactaggatattagggtcacattcttggctttcatcataatttcctctgtgatttttctgggtctaagtgtgcataatgcatacaaaaatgaagactctgaagatgatgagctcttctagttaaaaatctgatttccctgatataggaaagagattttaaatagctaagagtacttaaccaaaacacaggattaaccatttgttaggctttataaattaaaattcactttactatatcctttagaaaagcctgggcattttttcattcagatttctgtataaattcaagaagacatgaaaactctacaaggaagggtttaataaatgagaggcctggatttaaccagctgaggtggttgacaatctaagtatttgcctagtacaaccttttataccagtctagtgccttagcatcaacaaggttcttacagaattcctaaggcaactaactctaaggcagtcaaggcaggaataaaatcttttctgctgtaccaggaaggtagcaactacaataagtaacaataagaccagataaaggaagaatgaggctcatctttcaaaagaaatgctctggtggacacataattacaaatgagaaaatctaaaatgaatctctgtggataaatcactctggcaacaactccattgacaatattatagactgtacaagctctgacccagacaaggtccacag

SEQ ID NO: 1521 - DNA, 700 bp, Homo sapiens
aggaaggtagcaactacaataagtaacaataagaccagataaaggaagaatgaggctcatctttcaaaagaaatgctctggtggacacataattacaaatgagaaaatctaaaatgaatctctgtggataaatcactctggcaacaactccattgacaatattatagactgtacaagctctgacccagacaaggtccacagctccatattctttatgcttagtaccactattctgtgcagcaggctagcagatgtatgggggctaagcatgttcaatactgaataactaaggcccatcactacagtgtgattaccaattctatatcacttcttcagtaataaagttcttaaggccatgaaatataattgtatcaaaacactgttcaccttctagtaactctcaaaggataccaggctgaggctaaaattcttttaaaacaggtatttaatattcttcacattccagtaataaagacgtttatttaaactgaagattattttaaaagcataccttttcatttgcaaaacctgcatttgacccatttccttcaaatgttgttttctttcttcttcaacttcttttagttcctcatttctttttcttaaagtaaggttatcttgtagccacctttcttgtatctaaaggtaaacattaaattagttaacaaaaataaccaagttactaacatgaaatctgtaa

SEQ ID NO: 1522 - DNA, 700 bp, Homo sapiens
ttaaaagcataccttttcatttgcaaaacctgcatttgacccatttccttcaaatgttgttttctttcttcttcaacttcttttagttcctcatttctttttcttaaagtaaggttatcttgtagccacctttcttgtatctaaaggtaaacattaaattagttaacaaaaataaccaagttactaacatgaaatctgtaacaggcaactggtgacagcaagtgccatttctgtcttacttagaatcatgtgaaattcaacagagggagaataagccagtgtgaaggaatctacaggtctggggcaatctggatggcccatccccatccacagtgacaagtgtaatacctcctgtagcgcagcttttactgctctttcacaaccataatctaaaaaccaggtctactgtttgatggggagtctcataaagatttgagcatatatctgtgtacttatttacttataaagtattaaaaacatacaaaacagacattttaaatggtgaaattaaaaatataactagatattttaatacctacatccccagtggatcattttgcataggaaccccatgataaagcctactgacctgaaagattataagagatcaatactactactgaagtcttccccaactttttcgtcctagttctgtctcccaacatgtaccaagaccattagaacctgttaggtatatgtt

SEQ ID NO: 1523 - DNA, 700 bp, Homo sapiens
tggtgaaattaaaaatataactagatattttaatacctacatccccagtggatcattttgcataggaaccccatgataaagcctactgacctgaaagattataagagatcaatactactactgaagtcttccccaactttttcgtcctagttctgtctcccaacatgtaccaagaccattagaacctgttaggtatatgttacctgcaacttctacctttaggttgacaaattgtaatcactcaaggcagtaagaagtgccacaatagtagcatatatctatgaacttggtacctccttagccaccgaaatgaaatttcaaaaaattggctgttcttgttgagtagttttgtccttcaaaagagactcaataacacttagcagcagcagcaacaacaacaaaattatttcagtggttttcctggtgattaaaatgaactatgttgtcaagagacaatcattagaaaacagtttttaagttgattctttggaatttagaggaaaaaaaatttcctgcagaaagaagggtgatttggcccacaaatcatgtgtatagaaaacttattctgaatttggagtaaggatttctcaaagagggagctgggaccctcctgcaatagcccttgcagctaagctaaactcagtgacatgggaagtgagagagatggacagacctgtggcaatatcttgcaccaacagta

SEQ ID NO: 1524 - DNA, 700 bp, Homo sapiens
gaaaaaaaatttcctgcagaaagaagggtgatttggcccacaaatcatgtgtatagaaaacttattctgaatttggagtaaggatttctcaaagagggagctgggaccctcctgcaatagcccttgcagctaagctaaactcagtgacatgggaagtgagagagatggacagacctgtggcaatatcttgcaccaacagtaaaggccagggactggtagatgagagagggaaatcaaggatttctctcacatgcttaatgttcatatccaatcctgcccctctatgcgtgactatttttagagttttttttttcttttttaacagtcacaaagtaaggctactttcatttttcctggaaataatataaacatacaatttatccacagggtccacatctacggattcaactaaccatggatcaaaaatattggggaaaaaaaataaaaagtaatagtacaataaaaaaatacaaatttaaaataatacaatataaaaactacgtatcatttacatattaatatcaaaagcaatctagagattaaagtatatcagaggatatggataggctatatgtaaacactagatatgccattttatataagggacttgagcatcctagatttcggtatctgttttatcgggggatcctggaaccaatccctcccagagataccgagacaactgaatatgtatctacta

SEQ ID NO: 1525 - DNA, 700 bp, Homo sapiens
acgtatcatttacatattaatatcaaaagcaatctagagattaaagtatatcagaggatatggataggctatatgtaaacactagatatgccattttatataagggacttgagcatcctagatttcggtatctgttttatcgggggatcctggaaccaatccctcccagagataccgagacaactgaatatgtatctactaaaggcattattataggcagttaaaggtgactaaaatgacatggttataaatgtcctttgttgctaaagcaatctaatgtaccactgtagctggtgtgacttaccaaggttctactatggggtactatgcttgttgttccttattaggaacaagggaatgtgctactgcttactttcatctaataccccagaacatttgaatttgttttcacaattgcatgaaaggactctttaaagtgctatcacatttttagatgagactgatttttggcacaaaatattgttgctggtctgtctacctgcattgttaccagacagctaggcatttctttgttttaggtcagcttccattattcttctagttttgaaagacagtatataccacatcaagagtgtaatgctttgaagtcagatacatctaggctcaaatcacagtgttattacttttaaactggataactttgggcaaattagtttaaattctctgaacctcagtttgc

SEQ ID NO: 1526 - DNA, 700 bp, Homo sapiens
ctgcattgttaccagacagctaggcatttctttgttttaggtcagcttccattattcttctagttttgaaagacagtatataccacatcaagagtgtaatgctttgaagtcagatacatctaggctcaaatcacagtgttattacttttaaactggataactttgggcaaattagtttaaattctctgaacctcagtttgcttataacatggtcaataatgatactatctatcataaagaactattgtgtggccgggcgtggtggctcatacctgtaatcccagcactttgggaggccaaggcagatggattacttgaggtcaggagttcgagatcatcctggccaacatagtgaaaccccacctctactaaaaatacaaaaattagccaggcctggtggcactcgcctgtagccccaggcaggttgaggcaggagaatcacttgaacccgggaggcgaatgttgcagtgagccgagattgtgccactgcactccagcctgggtgagagagcaagactccatctaatttaaaaaaaaaaaaaaaaaaaaaaagactattgtgaagattaaaggaatgagtgtatgtaatcagtatagtgcctgactcaataattgctaataaaatgccttttgggtcaaatttgtcctttgtactgtaagcagtgagaattccaattatagtctacaaaatgtatcagag

SEQ ID NO: 1527 - DNA, 700 bp, Homo sapiens
tgggtgagagagcaagactccatctaatttaaaaaaaaaaaaaaaaaaaaaaagactattgtgaagattaaaggaatgagtgtatgtaatcagtatagtgcctgactcaataattgctaataaaatgccttttgggtcaaatttgtcctttgtactgtaagcagtgagaattccaattatagtctacaaaatgtatcagagaaaggaagggaaaaaaaatcagatgcagttatagtataccacaaatgtttttccattctactagaaatttgatagtgtagggtccagttctacctgttactactttttgtgaccttggacaagtcaggtcacctacagttctcttcatatattccttcagctgaaaactgagaaaggcagttaagtttccaaattattttattctgtggactaaatttagcagggcttaaatcagtacgtaaataagtgactgttaggctcctcagctcttaaatattaaccccaatcatccaactcagatgacagttaatgcatgcagctggtcacctatggaaacataaaaattagctgcattctagatacctgtgagagagtggcatgctgaacagattacagtccaatgtccaccaaaagtctagctgggaataacaccacttctacaagactgcctgaaagctatgcagtccatccagtgctggctcagttattgacagctaaa

SEQ ID NO: 1528 - DNA, 700 bp, Homo sapiens
gatgacagttaatgcatgcagctggtcacctatggaaacataaaaattagctgcattctagatacctgtgagagagtggcatgctgaacagattacagtccaatgtccaccaaaagtctagctgggaataacaccacttctacaagactgcctgaaagctatgcagtccatccagtgctggctcagttattgacagctaaagggatatattagaacctctaaggaatttcaacaaaacacacatatctctgcccaaacccccaagattctgatttactggtgtggattggagacatagacatatatatatatatattttttgagacagggtcttgctctgttgcccaggctggagtgcagtggcgtagtaagggctcactgcagccttgaactccccagctcaagcaatcctcccacctcagcctcctgagtagctgggactacaggtatgcaccatcacacctggctaatttttttgtagagatggggtttcgccatattgcccaggatagtctggaactcccaggctcaagcaatctgcccgcctcggcctcccaaagtgctaggattacaggcatgagccactgtgcccggccaacacatgtatttttaataacctaagtcattttttaaaaactgagatgtaattaatattccacaaaattcactgtttaaacgtgtacaatttagcagttttact

SEQ ID NO: 1529 - DNA, 700 bp, Homo sapiens
ttgcccaggatagtctggaactcccaggctcaagcaatctgcccgcctcggcctcccaaagtgctaggattacaggcatgagccactgtgcccggccaacacatgtatttttaataacctaagtcattttttaaaaactgagatgtaattaatattccacaaaattcactgtttaaacgtgtacaatttagcagttttactttatttacaaggttatacaaccatcaccactatccaattccagagcatttgatcatcccaaaaggaaatctcatattcaatagcagtcactctattccttcctcacctctagccccctggaaacattaatctgctgtcactggatttacctaatctgtacatttattataagtggaatcgtacattatgtgaccttttgtgactggcttcttttgcttagcatgttttaagggttcattcatgtggtagcatgtatcctttttatggctgaataatattccattgtatgggtataccacattttgtttatctgatcatcagttgatggccatttgggtgtgtccatattttgactattacaaataatgctgctatgagcattcttgtacaagttgttgtgggaacatatgttttcaattttcttagttctatacctagaagtggaaaaactcagacgatttacaggtgcccctagctaagaacctttgctttctaaaca

SEQ ID NO: 1530 - DNA, 700 bp, Homo sapiens
cattttgtttatctgatcatcagttgatggccatttgggtgtgtccatattttgactattacaaataatgctgctatgagcattcttgtacaagttgttgtgggaacatatgttttcaattttcttagttctatacctagaagtggaaaaactcagacgatttacaggtgcccctagctaagaacctttgctttctaaacattaacatttacttcaggcttcaatcataccaccctctacagaacctcgtatcaaggaataatgatgctgagatacactgtattttttttaaagccctgcgaagtctgttgaagactatacatgtcttcctttctatgaatagagacattatcctgtagtcagtataggaaactggttttcttttagcattgacacaatgtgaatcttgactaattgtgacttttttttttttttttttttttttaagacggagtctggctctgtcacccaggctggagtgcagtggtgcgatctcggctcactgcaagctctgcctcccaggttcacgccattctcctgcctcagcttcctgagtagctgggactacaggcgcccaccaccaggcctggctaattttttgtattttttagtagagacggggtttcggcgtgttagccaggatggtctcgatctcctgacctcgtgatctgcccgccttggcctcccaaagtgctgggat

SEQ ID NO: 1531 - DNA, 700 bp, Homo sapiens
tcactgcaagctctgcctcccaggttcacgccattctcctgcctcagcttcctgagtagctgggactacaggcgcccaccaccaggcctggctaattttttgtattttttagtagagacggggtttcggcgtgttagccaggatggtctcgatctcctgacctcgtgatctgcccgccttggcctcccaaagtgctgggattacaggcgtgagccaccacgcctggctgtttttgtttctgtttgtttgtttgtttgtttgagacggagtttcactcttgtcacccaggctgaagtgcaatggtgtgatctcggctcactgcaatctctgcctcccaggttcaagcgattctcctgcctcagcctcctgagtacctgggattacaggcgcgtgtcaccacacctggctaatttttctattttcagtagagatggggttttaccatattggccaggctagtcttgaactcctgacctcaggtgatccgtctgccttggcctcccaaagtgctgggattacaggcatgagtcactgcgcctggcctcctctctttatttgactactagaatcttcagcaagcatatcagacttcatgcatactttttatacacttctctcctggtttcattactttcttgcccttatttctacactgccttgttttcccattaatttgaaatacatttatctttgctctatt

SEQ ID NO: 1532 - DNA, 700 bp, Homo sapiens
tcccaaagtgctgggattacaggcatgagtcactgcgcctggcctcctctctttatttgactactagaatcttcagcaagcatatcagacttcatgcatactttttatacacttctctcctggtttcattactttcttgcccttatttctacactgccttgttttcccattaatttgaaatacatttatctttgctctattgtatataactaagtaaataatttctggaacaaggaaggttacaaagtaaactaataccatcagatccactaagtttagaccatcactttaaaaggggtcatagatcattaatcttaacaatttcgtatatatatacagagagctgctgcgaatttacagattgtgatttttatataggcaactacataaaagctagtgataattattttgttatatatgcatcataaatttatacagttattcaatatgtattaggccaggcagagatttgatctccctttgactgatatttcatatatttgaaattcttggtggtacagaaagagacccagcagaaaactaatgtaactaatcttccaaatgattttaagcaaccacttataaccaagtggttaaggcattcaaatagtaaattttgtttaaaacagtaagaacagagaaatggtatagtttttaaaggcattaactaccatgcttgcataaagcatgtgatgatggc

SEQ ID NO: 1533 - DNA, 700 bp, Homo sapiens
tttgaaattcttggtggtacagaaagagacccagcagaaaactaatgtaactaatcttccaaatgattttaagcaaccacttataaccaagtggttaaggcattcaaatagtaaattttgtttaaaacagtaagaacagagaaatggtatagtttttaaaggcattaactaccatgcttgcataaagcatgtgatgatggcttcttaatatgattttgattatactatagaaattaatttctttaatagagaaaataaatgatataggaatcaactggaaaatgacttaatatataaatattttccttacagattactttcaagattattaaaccttaatccgtcttttgtgaatttatgctacataaagatatgttagaataagaaaagatacagatacatgttaaagatgttcattgtcacacagtttgtgataaggaaatgaaatcaatctgagtaagtgctggtatatacacaaaatggactattttataatcattaaaaagaatgtgatacatctgtgagttgataggtaaaatcaaattatgttaagtgaaaaaaggtacagaataacatgatacgaccccatccataaaagtaaatttaaatatatatatatatatatacacacacacctaaatttatctacctatctgctggtatatgaataaaaaacttctttaagaacaaataagtgtaa

SEQ ID NO: 1534 - DNA, 700 bp, Homo sapiens
taaaaagaatgtgatacatctgtgagttgataggtaaaatcaaattatgttaagtgaaaaaaggtacagaataacatgatacgaccccatccataaaagtaaatttaaatatatatatatatatatacacacacacctaaatttatctacctatctgctggtatatgaataaaaaacttctttaagaacaaataagtgtaacagttaatgacatgtagaagtaagattgagaattaggagaaggggaggaacacttttatgcctttatgttcgaacttttaccatgagtcttttactgaaaataaaaataaaaaataaatgaagtaagaatgttattggaattatttttctttactttttgcatttctttttagagacagagtctcgctgtgtcgcccaggctagagtgcagtggtacaatcacagctcactgcaacctctgcctcccaggttcaggtgattctcatgcctcagcttcccgagtagctgggactacaggtgcgcgccgccacggccagctaatttttgtattttcagtacagacagggtttcactgtgttggccaggctggtcttgatctcctggcctcaagtgatccacccgcctcggccttccaaagtgcagggattacaggtgtgagccaccacgcttggcctctttcctttttgcatttctattcaatggatcttctattgaaaat

SEQ ID NO: 1535 - DNA, 700 bp, Homo sapiens
tgcgcgccgccacggccagctaatttttgtattttcagtacagacagggtttcactgtgttggccaggctggtcttgatctcctggcctcaagtgatccacccgcctcggccttccaaagtgcagggattacaggtgtgagccaccacgcttggcctctttcctttttgcatttctattcaatggatcttctattgaaaataaaactatagaaaagaatgtcataggtgtaagtgatatcataagcaaaacagacctaccttctgtgtatcaatatcttgtctcatgagtctcatatcttcatttatcttttctttgtgtttctcgcattcacttagttgagctattactttattaagttcagtttctttttgctacaaaaaagaaaattctttaagcacatgaataaaaatacaatcaaataaataattttaagttttaaattaccttcttatagtcgtctttcccatcttgaatataattctcaatgtctttcatatagccatgaatatttttaaccttctctttaatatcattcagctgtagaaaaatattcattaaatttacactggttgtacttaagggcacataacaggagagcacagtaaaacactggctgggaagttatgaacattgggttccagtttccaccactactgaattttatgatcgcagacaagtccctttctcacctataggaa

SEQ ID NO: 1536 - DNA, 700 bp, Homo sapiens
agccatgaatatttttaaccttctctttaatatcattcagctgtagaaaaatattcattaaatttacactggttgtacttaagggcacataacaggagagcacagtaaaacactggctgggaagttatgaacattgggttccagtttccaccactactgaattttatgatcgcagacaagtccctttctcacctataggaattgattaattagtctcatttcttaacttctattgtagatcaagcagcaaaataatttacatcaaatccttgttctaacaagaatttctaatgtcaaaattataccatgaatctgaaaatactatttatcttatgctatttaatttcatgtgaaataagtgtccgacgtggtgctatgaacataagtttaatacagatatttgataagtaaatatataaatgaaatcttactttatcctgtgctattttgttgcttgtattttttttgttgattaattcttctttttcttgctggaacttttccaatgttgtttccaaagggcttacctgctctttagcatcctaaaaatataaaaaagataaagtattatataatattccattatcttactttaggggtcagacttcacagtcttaataaaagcactttctatgtgccaggctctaaaagtcaactcatttgctcctttcaatgaccctatgaggacagtaccatcatt

SEQ ID NO: 1537 - DNA, 700 bp, Homo sapiens
tttccaatgttgtttccaaagggcttacctgctctttagcatcctaaaaatataaaaaagataaagtattatataatattccattatcttactttaggggtcagacttcacagtcttaataaaagcactttctatgtgccaggctctaaaagtcaactcatttgctcctttcaatgaccctatgaggacagtaccatcattttcagtcctatatttcaaacgagcaaacagacacagagaatgatttgtccagggtcacaacagccagtaaatgaagcagccaagattttaacccagtccagctccagagttcacgctcttaaccactacgcatgctatactgcatcaaccactaatttgattcttaatctaggccatgtgctcccaattatattagcgtgtggcttcaagcatgagttttcatgattttataggtgcccgtcactgctgcatgatcaaagaataggaaagctcattcagtccagacttttctttttcagatgaaaacatgatggtaaaaacacttctgtccttaagcttagcctgctaaggctacgcagatatttcatggtaataaaagcatactgttaaactaatgttggtgtctccacaactattttggaaggaacggggctttcaagtaataaactattttactaaatagaagtccccattatttagccttgtaacactaaatcta

SEQ ID NO: 1538 - DNA, 700 bp, Homo sapiens
gatgaaaacatgatggtaaaaacacttctgtccttaagcttagcctgctaaggctacgcagatatttcatggtaataaaagcatactgttaaactaatgttggtgtctccacaactattttggaaggaacggggctttcaagtaataaactattttactaaatagaagtccccattatttagccttgtaacactaaatctacaacgtagttatatgataaccacagttcaaaacagaggtcctcaagcactttaagattctgaagtactgagtgaatctatagaggtagatacaattatttagtaattacttcaatataggtctattttatcatactgggaagtggtatggtgtgttaggaagtcaaatgccctcagtgtcaaaagatctatcagaaaatcaactctgcttcctattagctgcataaacttaggcactcatgagacatttgtaaatctcaatttttctataaagagatttcatcatctaaatagggttgctgaggcactgaatggttcaatgtcaaagtgctttataaatagtaaaaaattatacagatgcaagtactattttatattatattctgaacctctgatattttgtaatctaaaatttaataaaaatttatagtaattattcagtaatatacttagtgcttattgaatgagtacgcataattatataaacctaggtaagattg

SEQ ID NO: 1539 - DNA, 700 bp, Homo sapiens
ctgaggcactgaatggttcaatgtcaaagtgctttataaatagtaaaaaattatacagatgcaagtactattttatattatattctgaacctctgatattttgtaatctaaaatttaataaaaatttatagtaattattcagtaatatacttagtgcttattgaatgagtacgcataattatataaacctaggtaagattgtttataactgtttataactggttgagtcttagatgtgattaatctatataagggatgtcaaatgcattccagtggcaactgagtgcctgctcactgtattggtaagggttctgaaaccacatccggaatcaaatggaaagagtgctatgactgagagtgaccgccatagataaaggatctgcagataagacaaacctcctgtacaagcaggaatccttatacagaattaaccaaccaccacctgaccacctccaataacatttactacttaaccaggcagccagttcttccttattatggcaaactccttcttccagaaatctttacttactagtacaagttctatcacttaggaaccacacaaataattattataccattttcatttgatcctcataatagctggttttcaaagggaatgcttccagtttttgcccattcagtatgatattggctgtgggtctgtcataaatagctcgtattattttgaaatacattc

SEQ ID NO: 1540 - DNA, 700 bp, Homo sapiens
ggcaaactccttcttccagaaatctttacttactagtacaagttctatcacttaggaaccacacaaataattattataccattttcatttgatcctcataatagctggttttcaaagggaatgcttccagtttttgcccattcagtatgatattggctgtgggtctgtcataaatagctcgtattattttgaaatacattccatcgatacctagtttattgagagcttttagcatgaagcggtgttgaattttatcgaaggccttttctccatctattgggataatcatgtggtttttgtctttggttctgttcatgtgatggattacatttattgatttgcatatgttgaaccagccttgcatcccaggaataaagccgacttgatcgtggtggataagctttttgacgtgctgctggattcggtttgccagtattttattgaggatttttgcatcgatgttcatcagggatattggcctgaaattttctttttttgttgtgtctctgctaggttttggtatcaggatgatgctggccttataaaatgagttagggaggattccctctttttctattgttaggaatagtttcagaaggaatggtaccagctcctctttgtacctctggtagaattcggctgtgaatctgtctggtcctggacttcttttggttggcaggctattaattactgcctcaat

SEQ ID NO: 1541 - DNA, 700 bp, Homo sapiens
tgtgtctctgctaggttttggtatcaggatgatgctggccttataaaatgagttagggaggattccctctttttctattgttaggaatagtttcagaaggaatggtaccagctcctctttgtacctctggtagaattcggctgtgaatctgtctggtcctggacttcttttggttggcaggctattaattactgcctcaatttcagaacttgttgttggtccatttggggatttgacttcttcctggattagacttgggagggtgtatgtatccacgaatttatccatttattattttctagtttatttgcgtagaggtgtttatagtattctctgatggtagtttgtatttctgtgggatgggtggtgatatcccctttatcattttttattgcatctatttgattcttctctcttttcttctgtattagtcttgctagtggtctattttgttgatctttttaaaaaaccagttcctggattcattgatttttttgaagggtttttcgtgtatctccttcagttctgctctaatcttagttatttcttgtcttctgctggcttttgaatttgtttgctcttgtttctctagttcttttaattttgatgttaaggtgttgaattcagttatttcctgctttctcttgtgggcatttagtgctataaatttccctctacacagtgctttaaatgtgtctca

SEQ ID NO: 1542 - DNA, 700 bp, Homo sapiens
gggtttttcgtgtatctccttcagttctgctctaatcttagttatttcttgtcttctgctggcttttgaatttgtttgctcttgtttctctagttcttttaattttgatgttaaggtgttgaattcagttatttcctgctttctcttgtgggcatttagtgctataaatttccctctacacagtgctttaaatgtgtctcagagattctggtacattgtatctttgttctcactggtttcaaagaacatctttatttctgccttcatttcgttatttaaccggtagtcattcgggagcaggttgttcagtttccttgtagttgtgcggttttgagtgagtttcttaatcctgagttctaatttgattgcactgtggtctgagagactgtttgttatgatttctgttcttttgcatttgctgagagtgttttacttccaattatgtggtcaattttagaataagtgcgatgaggtgctgagagttctggccattacactaataaagagcatttcatattaaagaaacatgggctgggtgaggtgatgtaagcctgtaattttgggaggccaaggctgcattgcttgaggccatgagtttgagaccagcctgaacaacatagtgagaccctgtctctagaaaaattttaaaaattagccaggcgtggtggtgtgtgcctgtagtcccatctacttgagaggc

SEQ ID NO: 1543 - DNA, 700 bp, Homo sapiens
ataaagagcatttcatattaaagaaacatgggctgggtgaggtgatgtaagcctgtaattttgggaggccaaggctgcattgcttgaggccatgagtttgagaccagcctgaacaacatagtgagaccctgtctctagaaaaattttaaaaattagccaggcgtggtggtgtgtgcctgtagtcccatctacttgagaggctgaggcaggaggattgcttgagctcaggaggtcgaggctgcagtgagtgagctgtgactgtaccactgcattccagcttggaagactgatgaagactctgtctctaaaagagaagaatggggcggggcatgctggctcacgcctgtaatcccagcactttgggaggccaaggtaggcggatcaccttagttcaggagtttgaaaccagcttgtccaatggcgaaaacccgtctctactaaaagaacaaaaattagccaggcatggtggtgcacgcctgtaatcccagctactccagaggctgaggcaagagaatcacttgaacccaggagatggaggttgcagtgagccgagatcgtgctactgcactccagcctgggtgacagaacgagactgtctcaaaaaataaaaataaaaataaataattaaaataattttacaaaaaacatgtatggatattcttacctttatctctctgtacaaagactgaacttcagtgga

SEQ ID NO: 1544 - DNA, 700 bp, Homo sapiens
gctgaggcaagagaatcacttgaacccaggagatggaggttgcagtgagccgagatcgtgctactgcactccagcctgggtgacagaacgagactgtctcaaaaaataaaaataaaaataaataattaaaataattttacaaaaaacatgtatggatattcttacctttatctctctgtacaaagactgaacttcagtggataattccacagtctgctcctccagttgctgacgacgttgcaaattagtggatatctgaagtttctcagattttagctcatttgttgtactttttagatgttgaatctgttcctgctggtcctgtataagcttacgattcaattcaatcttactagaaactacacaaaaacatattatcacagtaattaatgtaagggcatagaaaatactatttgtatcattcttcccatttttatcggtctatggaatccacaaatgctatttctgtgggccccacccactgcaacaaaaatacaatgagaaccctgctagttctcaaatcagcttgatgttccctgctggccactcacagggaaagcttacagggcaggtatgaatgagaaagaatacagctcatggccaggcgcactggctcacacttgtaatcccagcactttgggagactgaggcaggtggatcacctgaggtcaggagttcgagatcagcctgacaaacacag

SEQ ID NO: 1545 - DNA, 700 bp, Homo sapiens
gagaaccctgctagttctcaaatcagcttgatgttccctgctggccactcacagggaaagcttacagggcaggtatgaatgagaaagaatacagctcatggccaggcgcactggctcacacttgtaatcccagcactttgggagactgaggcaggtggatcacctgaggtcaggagttcgagatcagcctgacaaacacagtgaaaccccatctctacgaaaaaatacaaaaattagctgggcatagtgatgtgtgcctgtaaccccagctactcaggagggtgaggcaggagaatcacttgaacccgggaggcggaggttgcagtgagccaagattgcaccattgcactccagcctgggcgacaaaagtgaaactctatcttaaaaaaaaaaaaaaggaaaagagaatacagcttatttcatactctcctactgttcaaaatctgttgtgcaaagtaagagaacaaagagaagtgatgcttttcagaaaaaaagagcaaatatatgtggacaggaaggaacttcgttgtccatgtaacagatataaaattgactgtaaaaggcatgtgctcgcaatgtcaaagtctctatgagtacagaaggacacagactgtattacctgtgtctaacttgtgctgtttctcttgtttctcctggttgacttgttggacagttcgatctaagtctattccttgtagct

SEQ ID NO: 1546 - DNA, 700 bp, Homo sapiens
aatatatgtggacaggaaggaacttcgttgtccatgtaacagatataaaattgactgtaaaaggcatgtgctcgcaatgtcaaagtctctatgagtacagaaggacacagactgtattacctgtgtctaacttgtgctgtttctcttgtttctcctggttgacttgttggacagttcgatctaagtctattccttgtagcttagctgcttgttgtgcaatttttctttcaacatctttaagttccatcttaagaatataacaaaatgatttcctttaataaacttactgcattattcaaaatctttaaaaattaattgctcttatcatttattttttaaatctaaacttataaaccatttctagatacaattttagcaaagtttaataggataaaagtgaaattaattatcagcaattcaaatgatgtaaacaaaaggaagctgactaaagatgaaaaacaaacagaactgtcttaatttttaaatttatgaattaaaaagtttaaacccagggatgtaaactaagcagtttctccctgagggtatctgaaattcaggatggggaattctaaacacaacctgtacctgaatactagctactatttttaactctcacacttcaaattcaagccaccatggaacaagttttattctgccttaaactacaataaacttacctggaacctctccataattgtaa

SEQ ID NO: 1547 - DNA, 700 bp, Homo sapiens
agtttaaacccagggatgtaaactaagcagtttctccctgagggtatctgaaattcaggatggggaattctaaacacaacctgtacctgaatactagctactatttttaactctcacacttcaaattcaagccaccatggaacaagttttattctgccttaaactacaataaacttacctggaacctctccataattgtaacatctgtcaggcatactttggcactttcttcttcaggcattattgtacccaagagtgtttcttgttcttctatgtcgttctttaggcgctgtatgtctctattgacattctgcagtttgtttcttaattctggtatttccttctccttcaaatcaattatgctttgcctaaatagaaaacacaattaaaaataaagtatctgatgtttctcacagttagactgaggttatgtatttttaggaagaataccacagaagtgacattgtgttcttttcagggtatcatatcagtggatatggaatcatgatatcaatatgtcttattactgatgatgttaatccttattcacttggcttagatggtgttggccaggtttctccactgtaaagttactgttttagtctttgtaattaacaagtatcttaggagagaaatgttgagactatgtaaatatcttgcttctcaactttctgcctactgattttagtatccactgaca

SEQ ID NO: 1548 - DNA, 700 bp, Homo sapiens
gaatcatgatatcaatatgtcttattactgatgatgttaatccttattcacttggcttagatggtgttggccaggtttctccactgtaaagttactgttttagtctttgtaattaacaagtatcttaggagagaaatgttgagactatgtaaatatcttgcttctcaactttctgcctactgattttagtatccactgacagatcttgcttgcaataattattactgtggtgtttgtcaaactgagaaatattctactaatgaactggtcatattgaccaaaagtgttaaggtcatgaaagataaagacagattgttacagactgcaggagcctaaggagaaataacaactagatgctacgtgggatcctgcatggaaccctgaaacagaaaaggcattgatggaaaaactgctaaattcgatatggtctgtaatttagttagtagcattatatcaatgttaatcctggttttgataactgtattataacagagtacataaattgttaacatcaggaggagctggatgagggatatatatgaataatttgtattatttttataatttttctgtaatcctaacattatttcaaaataaaaattttttaaattacaggaaaaaaaggaaggaagccagccactaagtgaaatgctacatgggtttaaggtacaaaatgtcaacccattttactggtactcac

SEQ ID NO: 1549 - DNA, 700 bp, Homo sapiens
aaattgttaacatcaggaggagctggatgagggatatatatgaataatttgtattatttttataatttttctgtaatcctaacattatttcaaaataaaaattttttaaattacaggaaaaaaaggaaggaagccagccactaagtgaaatgctacatgggtttaaggtacaaaatgtcaacccattttactggtactcactactgtagctaatgaattaccacctccatggcaggtactgacaactatttttgctgatgcctctgaaacaataatatgtatttaatcttttaaaaaaaatttacttcagaaatattccaaattcttatttaaaattatattgaattagtatgacaaagcagtagaataaattaaactggtctctaataggagtcttattataaacttaaagaataaccagaaactcaagtggctattacttaatgattttttaaaaatgcaaactatgaccaagaaatgccaacctgacctgtggcaacagacctatagttttttaaaattttttaattatttatttatttttatgctttaagttctgggatacacgtgcagaacgtgtgggtttgttacataggtatacacgtgccatggtggtttgctgcacccatgaacccatcatctacattaggtatttctcctaatgctatccctcccctagccccccaccagcagacaggcc

SEQ ID NO: 1550 - DNA, 700 bp, Homo sapiens
cagacctatagttttttaaaattttttaattatttatttatttttatgctttaagttctgggatacacgtgcagaacgtgtgggtttgttacataggtatacacgtgccatggtggtttgctgcacccatgaacccatcatctacattaggtatttctcctaatgctatccctcccctagccccccaccagcagacaggccccagtgtgtgtgatgttcccctccctgtgtccatgtgctctcattgttcaactcccatttatgagtgagaacatgcaatgtttggttttctgctcctgtgttagtttgctgagaatgatggtttccagcttcatccatgtccctgcaagggacatgaactcatccttttatatggctgcatagttactccatggtgtatatgtgccacattttctttatctagtctatcattgatggtcatttgggttggttccaagtctttgctatcgtgaacagtgccgcaataaacatatgtgtgcatgtcagacctacagtttttttttataccacagaaataggaggtatttgtattccacataataaatatgaaggtatgcaggttatgagtaattccatgccaatgtttcctcttgaacactgttgtcacagattagtagttggccttaaattatgtgcccaatatctaaaaagtgacacagctatgacagcctaataatga

SEQ ID NO: 1551 - DNA, 700 bp, Homo sapiens
catgtcagacctacagtttttttttataccacagaaataggaggtatttgtattccacataataaatatgaaggtatgcaggttatgagtaattccatgccaatgtttcctcttgaacactgttgtcacagattagtagttggccttaaattatgtgcccaatatctaaaaagtgacacagctatgacagcctaataatgatggccaagcatttattaaactggggacatctctgtgaagaactgtaggtatacatacaattttaaccctatttttacattttcctacacacacacaaaatctttcatcaatatggtctaggttttggtgccttcttttttgatgattacataagatgttaaaagaagttttctggccgggtgtgacggctcacgcctgtaatatgagcactttgggaggctgaggctggtgaatcacctgaggtcaggagttcaagaccagcctggccaacatggtgaaaccccatctctactaaaaatacaaaaaatcagttgggcgtggtgaagggcgcctgtaatcccagctacttgggaagctgaggcaagagaactgcttaaacccgggaggtggaggttgcagtgagctgagattgtgccactgcactctctgggtttgtttttcttttttttaaatttatgacattttattttttattttcaagagttaatttttctcacga

SEQ ID NO: 1552 - DNA, 700 bp, Homo sapiens
tacaaaaaatcagttgggcgtggtgaagggcgcctgtaatcccagctacttgggaagctgaggcaagagaactgcttaaacccgggaggtggaggttgcagtgagctgagattgtgccactgcactctctgggtttgtttttcttttttttaaatttatgacattttattttttattttcaagagttaatttttctcacgattcacaaggttttttaaaattattttcaatagataaatcataattgcaaacatttatggggtacaatgtgatgttctgatatatgtacacaatgcacaatgattaaataaaggtaatttaacatatccattaccttgcctgcctatcattttttatagacagacatttgaaatttactctttggatttctgttttttcagaaactcaattcacctatttttagacaacattccttttctaaggggattgtgtgtaaaaaggctcacacagatatggtactgaaaaaaacctgtgggagaaataccaattgagtttgcatttaaatgaggtgctataataaatgaatctgagtcagtactagacaaaatgataaacaggtacattttcagctgagatctcagtcatgatgttaggtttatattagatactggcgaatttgaggctttaaatgaaaatatttcccgcaaagaagataagcaagatatggctccccactacc

SEQ ID NO: 1553 - DNA, 700 bp, Homo sapiens
aaataccaattgagtttgcatttaaatgaggtgctataataaatgaatctgagtcagtactagacaaaatgataaacaggtacattttcagctgagatctcagtcatgatgttaggtttatattagatactggcgaatttgaggctttaaatgaaaatatttcccgcaaagaagataagcaagatatggctccccactacctctctgagctcatcttccacaacttttccctttggccttcaggtcaaatatgtctcagagattttgcactgcctagaatattcttcttatggacaactgcatggctgactccctcacttctctcaagtttccactccactgccaccttcatcaagtcccctcctaccacccttcagctagtccctattcccttatcttgctgtagttttctcaatgcccctgatcatcccctggcatattatatatttacttatttgtcatccatctcctccccactgggatataaactccatgagggcagggactttgtccattttgtttactgctgtattacctgcactccagtagactgcctatattggttgcatgaatagacagttctcatgatagtggtggcatcaagggcatattctaaaggtgaaaaagcaaatggtgcacagataaatttaatcttgttactttacccctcttcaccaataaccttccacctaagtgacta

SEQ ID NO: 1554 - DNA, 700 bp, Homo sapiens
cagggactttgtccattttgtttactgctgtattacctgcactccagtagactgcctatattggttgcatgaatagacagttctcatgatagtggtggcatcaagggcatattctaaaggtgaaaaagcaaatggtgcacagataaatttaatcttgttactttacccctcttcaccaataaccttccacctaagtgactatcataaatagacctccacaatgtctctgaaagtgaccccacgggatatttgaaagtagtatcctaaccagaggtggaaggaagcttaatgatcatgtaaatcaatcccctcactttacgtgggggatacgaaggcccaaatgggttaagtaacatccctaaggtcacccagcagagttggaatttgaagtcaacctgactgcactcttaggcaattgctttcccatatttaaaaaaaaaaaaagtcctcttggttgggcatggtggcttatgcctgtaatcctagcactttgggaggctgaggtaggaggattgcttgagcttaggagttcgaggcttcgatgagctataatcaatcacaccactacactccagcctgggtgacaggagcaagaccctatctatcaatcaatcaagtcctcttaattcattattgacctttcatttgtggatttatttaaacttaaaaaaagtgttttataatgttatttcctactatt

SEQ ID NO: 1555 - DNA, 700 bp, Homo sapiens
tgaggtaggaggattgcttgagcttaggagttcgaggcttcgatgagctataatcaatcacaccactacactccagcctgggtgacaggagcaagaccctatctatcaatcaatcaagtcctcttaattcattattgacctttcatttgtggatttatttaaacttaaaaaaagtgttttataatgttatttcctactattgggaagaagacttcctctctcatttgtcccaaactcatccttctccagttttccagaatggcccactgacattctgttagagcttgctaaacaaacaggggttcatcatttccctgctcttcgggtcttcaagttttggtttctttataaaaatggtttcctcacacatgtgtcctcacttagcagccctgccagcatcttggtccattttcagtgcttcctgtaggccttttctagcttcaggttctcttaaaatgtgtggtaaccagccatttacctggctaacctagctgagcccagtcatcccatgaaaccatgaaaaactaatcactgcgagacagttttgagggggtttgttacaagcaatcaataacgggaatagacactacagttctcattcattcagcaaatagttatcaaagttacaatatagaatatacaaatgtgtggttgcctagtctctaggtaaccagaatggcacacagatgctactgcagat

SEQ ID NO: 1556 - DNA, 700 bp, Homo sapiens
agtcatcccatgaaaccatgaaaaactaatcactgcgagacagttttgagggggtttgttacaagcaatcaataacgggaatagacactacagttctcattcattcagcaaatagttatcaaagttacaatatagaatatacaaatgtgtggttgcctagtctctaggtaaccagaatggcacacagatgctactgcagatatagggttaggcagattcaagtcagccacaagtacttcgacactcttcccatcaagagatacagtatcctccctcactgaatcttgggagtttctgtgaccactctaaccaacagaaaaagaagtgtcaccatgccagtttcttggtctaggccttaaaggacttgcagcttctacttcctgttcatggaatacttacccttaggatactctgtttagtaacccagtcactgtgctgccaaaagcccaagacgcatgcagaggccatgtgaagatgtcctattttgacagccccagctgagctcccagacaatagtgagcatcactgtcagtcatgtgagccatcaagaacatccagctcggttatgctttgagacgactgcagccaacatctgactgcaaccgtaagaccccaagtgaaagccacctagctgagcccagtcataccacagaaccatgaaaaattattgtgagacagatttgaggtttgttacatagca

SEQ ID NO: 1557 - DNA, 700 bp, Homo sapiens
gagctcccagacaatagtgagcatcactgtcagtcatgtgagccatcaagaacatccagctcggttatgctttgagacgactgcagccaacatctgactgcaaccgtaagaccccaagtgaaagccacctagctgagcccagtcataccacagaaccatgaaaaattattgtgagacagatttgaggtttgttacatagcaataaataattggaacagacattacagttctcattcatttagcaaatagttatcaaagttgcaatatacaaggaactgtggagatacaacgagtaagacatgcaccttactcttagaggggaaactgtggcccagcacggtggctcacgcctgtaatcccagcactttgggaggctgaggcaggcgattgcctgaggtgaggagtttgaaaccagtctggccaacatggtgaaaccctctctctactaaaaatacaaaaaaaattagccgagcctggtgacgtgcgcctgtaatcccagctacttgggaggctgaggcaggggaattgcttgaaccggggaggtggagattgcagtgagccaagactgcgccactgtactccagcctgggcgacaaagcaaaactctgtctcaaaaaaaaaaaaaaggagccgtgatagctagggtcctaaaatataatacgatgttaatttctgccatttattgtataacagtctaaca

SEQ ID NO: 1558 - DNA, 700 bp, Homo sapiens
ctacttgggaggctgaggcaggggaattgcttgaaccggggaggtggagattgcagtgagccaagactgcgccactgtactccagcctgggcgacaaagcaaaactctgtctcaaaaaaaaaaaaaaggagccgtgatagctagggtcctaaaatataatacgatgttaatttctgccatttattgtataacagtctaacacagaactaagctcatatttctactacgtgtactttctaccaatttcaaattttatccatttgatctttttcttttcaagatactaccttattcctctccttcctttttattctcaaactactgcctctgtctcctcatctctgtggccccaataatctggttttcacccttgatgcttgtgttggttatctattgttgcataacaaagtatcccaaaacttagcagcttaaaataacagcacttattatttctcagagatatgaggatcaagagatacgcttctgactcagggtctcgcatgaagtcgcaatcaagctgtcagccaggactgcagtcatcttaaggcttgactgctacaaagtctgcttccaaactcacttgctcaaaggcctcaggtccttggcatatgggcctctccagagggctgcttgcaacatggcagctagcttccctcagacaagagacagagggagacagagtgagtgagagaggggagga

SEQ ID NO: 1559 - DNA, 700 bp, Homo sapiens
catgaagtcgcaatcaagctgtcagccaggactgcagtcatcttaaggcttgactgctacaaagtctgcttccaaactcacttgctcaaaggcctcaggtccttggcatatgggcctctccagagggctgcttgcaacatggcagctagcttccctcagacaagagacagagggagacagagtgagtgagagaggggaggagtgggggagagtgagcgagttcacacaagggtacaagcacattgcgagaacagaagaagccatagtaccttaaataacctaatgttggaaaggccatgctatcacttctgcctgttttatcagttatatagaccaatcatgcaacagcatgagatgggactatacaagagtataaataccaagaggccgagattactagggaccatcttagaagttggctgccacaaaccacatcttcttaggcctttctttctccttttcctgaaactcctccttggttttccaggacaatcactttcactctcctggtttttctgcttcctgagcttttctcagcctgtttcagtcaatatattaatattagattaattttcctaaaatacatctttcactaactcccttaggttggctcctcatcacctatcagagttacaactagacctgaatataatgtagccctatctccccaacatacaggactcaatccctataaataatt

SEQ ID NO: 1560 - DNA, 700 bp, Homo sapiens
cactctcctggtttttctgcttcctgagcttttctcagcctgtttcagtcaatatattaatattagattaattttcctaaaatacatctttcactaactcccttaggttggctcctcatcacctatcagagttacaactagacctgaatataatgtagccctatctccccaacatacaggactcaatccctataaataattccccaaactccagataacatttctactgcagcataggtcatactcctcttccctttgcaccgtgttctgacttccgtctcctctcagttgagctgaatgaacttctccaggtcttatattcctcttcctgcctcattctcaaaatattcttctcattctgtatccattggctcctcccttcttacctaacacatctgtttgaatcattttttaagcactttattaagcctagctttctaaatgttgaattctgagagcttgtcttcttaatcagaccattagctcctggagggtcatgtcttaggtctctggcactagccttgttctctatgttctgggagacactaaggcaatcatcacatatttcctgacttgatttttgtttgtaaacagaacataacacgaatttcttgtataagtgatggaaaatataaacaaccgaaaatcatctatgattcattcttttagcaagtggaaaagacattaaaaacatagttta

SEQ ID NO: 1561 - DNA, 700 bp, Homo sapiens
tcttaggtctctggcactagccttgttctctatgttctgggagacactaaggcaatcatcacatatttcctgacttgatttttgtttgtaaacagaacataacacgaatttcttgtataagtgatggaaaatataaacaaccgaaaatcatctatgattcattcttttagcaagtggaaaagacattaaaaacatagtttaaaatctgtcttctgggagaacttttcaatacttaaattcttttgctgggttcagaaagtggcatgtcaacagacagtcctaaatctgtgaaaatctatgcccacaagctaagtcttgggaattaaacacacatacaaaagaacgtaaagactgtgtctacctcatagtttaagaaataagcttactggctatgcacggtgctcacacctgtgatcccagcactttgggaggccgaggtgggccaatcactttgaggccaggagctcgagattagcctggccaacatggtgaaactccatctctactaaaaattacaaaaattagctgggcgtggtggtacatgcctgtaatcccagctactgaagaggctgaggcatgggaatcgcttctgggaggtggaggttgcaatgagccaagatcatgccactgcactccagcttaggtgacagagagagactctgtctcagaaaaaaaaaagaaaaagaaaaaaagacaggaa

SEQ ID NO: 1562 - DNA, 700 bp, Homo sapiens
tctctactaaaaattacaaaaattagctgggcgtggtggtacatgcctgtaatcccagctactgaagaggctgaggcatgggaatcgcttctgggaggtggaggttgcaatgagccaagatcatgccactgcactccagcttaggtgacagagagagactctgtctcagaaaaaaaaaagaaaaagaaaaaaagacaggaaacaagcttatctttaaacaaaataattgaatcttcttatcatagaagtgatataagacagggcataccagctcagagtccttactgagtaactaccatctgcccaggcatgagatgggtaccttttacaatgtgctgctacatgtacagtgaaggtaaatcccattcttacctcatgggcacaagtcccagcatttcatcacgccgcttttcctttttttttagctctgattctgttgacttgagtttatctggagcaagtcgcagtttagactgcaaatcactgatgacttcttgtaactcagcctctgtctgaaaaactctctgacaaacggggcaacatgactggttttcgtctgttagctgagtaatgaactgggagtaaactgctgtggctccagccagcatggctattttaagaaaataaattatatcaccaatgagaaaaaaacataaaatacagtattctgaatacggttgtatctttttctataaatata

SEQ ID NO: 1563 - DNA, 700 bp, Homo sapiens
actcagcctctgtctgaaaaactctctgacaaacggggcaacatgactggttttcgtctgttagctgagtaatgaactgggagtaaactgctgtggctccagccagcatggctattttaagaaaataaattatatcaccaatgagaaaaaaacataaaatacagtattctgaatacggttgtatctttttctataaatatatgattattcttgctttataaatatattataaaagaaataaaaattctgatatttaaaattccgatattcgcttccaaagagcatgatacattcagatttgtataaatattttttggtaacacattataagtataacaaaatgcctactgagagctttctatgtgccaggcactgttctaagggctttataattacaatctcattcacacctcagtaccacaggtggtagttgtgtcctcattttatagacaatgaaacacaggaaggtttcagtaacttgcctaaagtcacacagtgagtaagttgtagagccaggactgaaatccaagccattaggctccataaccaggtttttaaattccccatccttaacagttacctgtgaatgaaaattcaaaggtgtcaaagtatcctgataatataaagtagacaacttacctcgctgttttgatgatttttcaatttcctctttaagcctgtctaaatcactttcaaaatc

SEQ ID NO: 1564 - DNA, 700 bp, Homo sapiens
gtaagttgtagagccaggactgaaatccaagccattaggctccataaccaggtttttaaattccccatccttaacagttacctgtgaatgaaaattcaaaggtgtcaaagtatcctgataatataaagtagacaacttacctcgctgttttgatgatttttcaatttcctctttaagcctgtctaaatcactttcaaaatcctggctaccacaaacatcaaacagcttgtcttcgtaactggacaactgctcttcctttctttttagttcattatttatatgatttttattctgctcagatgaagctagttccttgctaaaataagagcaaatatggattttcattttaaaataggagaaattagtttgaaaatttgagtaggcaaaaacaagacaaattctgccaacaaatcatgacaagagtttggtatgaccaaataatttttttcagaagttgagggactagtccacttctgccttaactctccccctaggacactgactcacctgccagtcctactcatgggcctgctcccagaaaaatgtacacagaattctgcctggtttctgggggttcatggtctttgatcccaggttaagcctcagcaagatgcttgctaggactattggacagaaagaagacaagagaacatccccgtaattccctttagtcctttcacaaatactacttccttactct

SEQ ID NO: 1565 - DNA, 700 bp, Homo sapiens
tgactcacctgccagtcctactcatgggcctgctcccagaaaaatgtacacagaattctgcctggtttctgggggttcatggtctttgatcccaggttaagcctcagcaagatgcttgctaggactattggacagaaagaagacaagagaacatccccgtaattccctttagtcctttcacaaatactacttccttactctcctgtaaatactgtttcttttgtatcctccccctccttgttgctgtcatccacttgcgtccagatcagtcattccctctcattcatcaaagattttgcttactagtacaatttatccccactttaattcttaaacatcatcctagccaacctcaatactcacacataacatggtttttcaatttgcaggtttagatgcattagctaccatgtaatcaatttaatgtattcagcatattttttaaaaatgaaacagaatagacggtaatatattggagtaggctgtatgtatatgtactactttgagaaatttgtttcagataaatgtgtgtgactgcacacatgcttcttcatcatgactacccatcctgagtcacagtaaacatttggaaaaaagtaactaatatgatgatattttcattatcctagactcccttgagcacttctcatcaagatcaccagtgacctaagtgccaagtacagtcttcatcttactctac

SEQ ID NO: 1566 - DNA, 700 bp, Homo sapiens
actttgagaaatttgtttcagataaatgtgtgtgactgcacacatgcttcttcatcatgactacccatcctgagtcacagtaaacatttggaaaaaagtaactaatatgatgatattttcattatcctagactcccttgagcacttctcatcaagatcaccagtgacctaagtgccaagtacagtcttcatcttactctacctctacgtagcaccaaacactgttgaccttctccttgaagactattttcccaaggcacctagacaccacagctatctggctctcaccctggttccctgggcacatcccagtttccttcacttgctccttttcctttgcctgctaacattttaaatgtttgtgcttcccaggaatctaattgtaactccttccctttgcataactctctcaaggtgacatactaatgactttgagtatcccttacatagcaacaacttccaatctcctgaatttcaaactccaatattgtattccctcacagatacttccacaagaaacacagattaaacaccaccaaagccaagtccttctactttcctcaaaaatctgtgtggaatttttgacccgcttatccaaccactatccaaggtaacatctgagaaacatgatcactttttataatggattactcacagaaatgaaaatagaatttttaaattttaatcttcataggtctaca

SEQ ID NO: 1567 - DNA, 700 bp, Homo sapiens
cagatacttccacaagaaacacagattaaacaccaccaaagccaagtccttctactttcctcaaaaatctgtgtggaatttttgacccgcttatccaaccactatccaaggtaacatctgagaaacatgatcactttttataatggattactcacagaaatgaaaatagaatttttaaattttaatcttcataggtctacaaattttcaagggacaagaggcctaaattactatccgttaccattttacttaatttgcaaaatatgaggggtcttcaaaatgttcatggaaaatgtgtattataaaaaaaactatgcatgaagttcaaaatgttttgcactgaaacaaactcatactaacttgttataacatgtctgaataggatctagtttaaggcactaacaaggttaagacatcagtttgaaaagagccccaattaaactgaagcaagaacaagtatcaaatttatggtgaagtgtgggtggaagaatggtgaaatcattgatactttacaacaagtttatgagatcaatgccccaaacaaatcagcagtttacaaatggataactcagtttaagaagggatgagacgatattaaagatgaagcccacagtgacagactgttcacatcaatttgtgaggaaaaaaaatcatcttcttcatgccctaactgaagaagatcaatgattaacagcagaaa

SEQ ID NO: 1568 - DNA, 700 bp, Homo sapiens
cattgatactttacaacaagtttatgagatcaatgccccaaacaaatcagcagtttacaaatggataactcagtttaagaagggatgagacgatattaaagatgaagcccacagtgacagactgttcacatcaatttgtgaggaaaaaaaatcatcttcttcatgccctaactgaagaagatcaatgattaacagcagaaacaatagccaacaccatagacacctcaattgattcaggttacacaattctgactgaaaaattaaagttgagtaaacgttctacttgatggatgcccaaaatcactgcttccagatcagctgcagacaacagcagaacttcctcaataagtgggatcaagttcctaaagcatttcttcaaagaattgtaacaggaggtgatggaatgtggctttaccagtacaatcctgaagacaaagcacaatgaaagcaatggctaacaagtggtggaagtggtccagtcaaagcaaaagcagaccagataagagcaaaggtcatggcaacagttgttggggatgctcaaggcattttgcttgctgactttctggagggccgaagaaaggtaacaactgcttattatgagagtgttctgagaaagctagccaaagcattagcagaaaaatgcccaggaaagcttcaccagagagtccttttccaccacaacaatgttcctgctcattcc

SEQ ID NO: 1569 - DNA, 700 bp, Homo sapiens
ataagagcaaaggtcatggcaacagttgttggggatgctcaaggcattttgcttgctgactttctggagggccgaagaaaggtaacaactgcttattatgagagtgttctgagaaagctagccaaagcattagcagaaaaatgcccaggaaagcttcaccagagagtccttttccaccacaacaatgttcctgctcattcctctcatcaaacaagggccatttgcaagagtttcgatgggaaatcattaggcatccaccttacagtcctgatttggctcctcctgtcttctagtttcttaatcttaaaaaaatctttaaagggcacccatttttatgctagcaatgtaaaaaagactacactgacatggttaaattcccaggaccctcagttctttaggactgaactaaattgctggtatcactgctcagaagagtcttgaacttgatggagcttatgttgagaaatacagtttatttaaaatttttatcttttaattccatttttccatgaactttctgaagtctccttgtatgtaagaactaaagtttatcaatataacataccatttcatgacaataaattattttaaaacaattaaacaggtaagcatgaaataagagatttctattacatctccaaatgttgcaacttacttcaatttggcaagtctgtccctggtctgattaatttcttttgat

SEQ ID NO: 1570 - DNA, 700 bp, Homo sapiens
catttttccatgaactttctgaagtctccttgtatgtaagaactaaagtttatcaatataacataccatttcatgacaataaattattttaaaacaattaaacaggtaagcatgaaataagagatttctattacatctccaaatgttgcaacttacttcaatttggcaagtctgtccctggtctgattaatttcttttgatttactatgtagccagtcttcaagctgttttttgttgggaaaatatcccaacagtgaggttaattcatcactgtgcctagattttatttttctgatttgttcatctttgtcagcctataggtaaaaaaaaaatcttttaaaaataaagtctatatctccacattatatcaagaacaaaaataaattctagactgactaaagttctaagcttaaaactataaaaatatgaaaataaaatataaaatttcttaaagttcttaaagtcttcaagtggggatggtctttctaagccttaagagtggagtaccaagtcgaacaatataaaattttaaaatttgtgtatgttaaaagttaacagtaatgtgcatgtgtgtatatacatatatatacatttctgtattaactttttgtaattaaacaataacttttaagcttgaaagtctattatatagagtactaagctcacttagcctctaaaatatagtcaataccaacttaat

SEQ ID NO: 1571 - DNA, 700 bp, Homo sapiens
tggagtaccaagtcgaacaatataaaattttaaaatttgtgtatgttaaaagttaacagtaatgtgcatgtgtgtatatacatatatatacatttctgtattaactttttgtaattaaacaataacttttaagcttgaaagtctattatatagagtactaagctcacttagcctctaaaatatagtcaataccaacttaataccttatagtctatgacttatgagtgcaaggtaggctattttaagtaccagacagtataattagaacaaaaagaaaaatcatactttgtctttggtcagcatctccatttgggtacgtgttgttgtatgatggtttaactgctccatctcctggtcaagtttacgcagggtcctgtctaagtctgctttttcattttggagacttattacttccatttttaaggtttctacattgctgtttttctcagccttgcttaactcacgttcctagtcaataattcatacaaatgcaaaggtgttatatattttgtgcaagaattaaaataatgacaaagtgtattagaaattaactactcctcagaatgttccaaatattactgtttgcatccaacaagagaaaaaaacataaggcactatatatgctctaaggtatatcttattaaagtgaccttactatgttataatggtagagaattagtaaataaacctagaagggtca

SEQ ID NO: 1572 - DNA, 700 bp, Homo sapiens
ttatatattttgtgcaagaattaaaataatgacaaagtgtattagaaattaactactcctcagaatgttccaaatattactgtttgcatccaacaagagaaaaaaacataaggcactatatatgctctaaggtatatcttattaaagtgaccttactatgttataatggtagagaattagtaaataaacctagaagggtcaaacaggaaagaaatgtgagaattactgtaaaattaggagacatgtgtctaagtacacagattagtgagtcctcagtcaacaattaaatatttattatgtccccatgtaattcactatattgcctggtatgtagaaactataaaaatagtgtgatgtggtccctgaccaagtatctccccaccccaacaagacaacactgatgaagtgctaaactgacaaaaatgtatgctacaatggtgagttatggagcaaaaataaatgtttacataaattatcaagatgggctttaagaagtttgccatgctttagaatgcttactttggtaatggagatgtgaagaaggaggacagactagaagcaagaaagaaaatatggaaatacctgaaaagattggctaagaaagtttttaacacagaaaaagtaataatacagcaaaaatcatctagaattacaacgtgtgtgacctagaggaaaaatacttgcttttttaaaactttgg

SEQ ID NO: 1573 - DNA, 700 bp, Homo sapiens
ccatgctttagaatgcttactttggtaatggagatgtgaagaaggaggacagactagaagcaagaaagaaaatatggaaatacctgaaaagattggctaagaaagtttttaacacagaaaaagtaataatacagcaaaaatcatctagaattacaacgtgtgtgacctagaggaaaaatacttgcttttttaaaactttggcaagtgttctttttcttttttttgagatggagtcccactctgtcacccaggctggagagcagtggcgcaatcttggctcactgcaacctctgcctcccaggttcaagcgattctcctgccctggcctcccaagtagctgggattacaggcacacgccaccacgcccagctaatttttgtatttttagtagagacggggtttcaccatgttggctggacaggtcttgaactcctgacctcacgttatctgcctgccttggcttcccaaagtgctgggattacaggtgtgagacaccgcacccggcctggtaagtgttcttaatcaaggtgctcataagaattagccagttttgttgtgttttgaatgtacatttctatgccccattctcagagattttgatttggaaggtctgaagctttaaggtctgagtacagtatctttaaaaagctccctatgtgattctaattttcaggctatcgggttgtagaaccaaagagtc

SEQ ID NO: 1574 - DNA, 700 bp, Homo sapiens
cccggcctggtaagtgttcttaatcaaggtgctcataagaattagccagttttgttgtgttttgaatgtacatttctatgccccattctcagagattttgatttggaaggtctgaagctttaaggtctgagtacagtatctttaaaaagctccctatgtgattctaattttcaggctatcgggttgtagaaccaaagagtcagaagatcaagatattcagatgaattcattttacatgagaataagacaaagttgatgtttttattaaaatgctataatcttaggatcaaaaatagacaaaatacttctaaaagtattatatcttaaaattattagattattcaaacaatatcttacagcttttatgagctcctggtccagttcaagaatcctgtctgaagatccttccaactgctgtaattcatacttcacatttttcagctcattctgcttcttacttaggatttctgattttaactcaattattcttcccagtccagttttcttatctcttatctcatctatctgtttttgtttcagagtctctttttctgcaaagtcattctaaatgcatatgtaaagaatgagcattaataatttactaaacaatttaagttttttaattgcaaaaggaatatatgtacactgaagaaaatacaaaaaagtacagtcgtgtgttgctcagcagggatatattcca

SEQ ID NO: 1575 - DNA, 700 bp, Homo sapiens
gttttcttatctcttatctcatctatctgtttttgtttcagagtctctttttctgcaaagtcattctaaatgcatatgtaaagaatgagcattaataatttactaaacaatttaagttttttaattgcaaaaggaatatatgtacactgaagaaaatacaaaaaagtacagtcgtgtgttgctcagcagggatatattccaagaaatgcatcattaggcaattttatcattgtgtgaacatcagaatgtatttacataagcctacatggtatagtttaatacacacatagactatatggtatagcctattgtttatgggctacaaacctatacagcatattactgtactgaatactttggcaactgtaacatgatgataagtatttatgtatctaaacatatctaaacacagaaaacatacagtaaaatacagtattataattttatgggaccaatgtcaaatatgtggtctatcactgaccaaaacatgtggttcaagactgtattttaaaaacaatcaaaaccattacccagagataatcattaactgtgagcaaatgttttctctgcaattagtttttaaaaatttttacttaaaaccaaataaaaaatgtaggtttacattttcttcatatttttatctttatacacttaagaacatttgcttcaataaaggtttttctgccttgtagcagatttt

SEQ ID NO: 1576 - DNA, 700 bp, Homo sapiens
actgtattttaaaaacaatcaaaaccattacccagagataatcattaactgtgagcaaatgttttctctgcaattagtttttaaaaatttttacttaaaaccaaataaaaaatgtaggtttacattttcttcatatttttatctttatacacttaagaacatttgcttcaataaaggtttttctgccttgtagcagattttatcctaacactaatagaaaaatatgccaaaatggagtccaaccaaaaattaaaacaattcaagtagagaatatgatgcaaacaaaataacaaatactgtatttcaaaatacttgccatcagttggttggcagtttttgcttccccttcttgtctctctctcacaagtttgtgaaaatttttaatctgtctttcactgaatggtccacgctcaaagccatccaattctagctgtgttgccaaagactgaattaatgaatctctagctcggatatgttcttgatggcgatctgcttgcagctgtagacgaccttttaaaaaaaaaatctcataatttttttttcaactggtgcttaaaaagttgagatagctgcagattcacgagttataaaaaataatgcagtgtgtctcttgtacattttgcccagtttctcccaatgataacattttgcaaaactgcagtaaaatatcacaaccagaatactgatattgatataattc

SEQ ID NO: 1577 - DNA, 700 bp, Homo sapiens
ctgtagacgaccttttaaaaaaaaaatctcataatttttttttcaactggtgcttaaaaagttgagatagctgcagattcacgagttataaaaaataatgcagtgtgtctcttgtacattttgcccagtttctcccaatgataacattttgcaaaactgcagtaaaatatcacaaccagaatactgatattgatataattcatcaatcttattcaaatttccccaattttatttgtacccctgagcatgtggatgtgtgtatattaagttctatataattttatcacctgtgtcggttcatatatccactatggcagtcaagatactgaacagttccaatactacaaggactctctttttgttctaatcataaccatacctagctccctcctgtcctttctcttacccagtatccctggcaaccactaatttctccactatttctaaaattttgacattataaaaatgttatataaatggaaacatactgtgtatagccttttaagattggcttttcactcagcataagtccttggagattcttcattcatacagaaaatgtataacatcatagtaggaaaaacgaccaaataaacattttgtcctaccctgttcaacaagcagttctgatttttcctgattgagaagcctagattctttatttagtttttccagttcacgatgacagtctaccaatttc

SEQ ID NO: 1578 - DNA, 700 bp, Homo sapiens
ttttaagattggcttttcactcagcataagtccttggagattcttcattcatacagaaaatgtataacatcatagtaggaaaaacgaccaaataaacattttgtcctaccctgttcaacaagcagttctgatttttcctgattgagaagcctagattctttatttagtttttccagttcacgatgacagtctaccaatttcctttctttctcccttactgttctctggtgattgtgatataagtcatttagttgctcatcagtcccttgaaaaacctgtgtaacaccaaaataaaaagctttaatgtacaaacataagaaaatatgatcactttgaggtatcaaatataaaccaaaccttattcaatatccttcattttaacatatacatagaagtaacaagatctgtatttgtttttttccaatgtggatggcaaaatggattcaaataaagttcattacaataatcccaaaattttgaagcagaacaaaattctaccaccacaaaccttttccattttctcttccagttcactattatctttctccatttgcttctttcggctatccaaggctttaatttcattgtcaagtttcattattttagagagattatgttcaatttcttttagacgattctgaaaataaagaaacattacataaataaaactcactatagcttacatggctgatagatgaag

SEQ ID NO: 1579 - DNA, 700 bp, Homo sapiens
accacaaaccttttccattttctcttccagttcactattatctttctccatttgcttctttcggctatccaaggctttaatttcattgtcaagtttcattattttagagagattatgttcaatttcttttagacgattctgaaaataaagaaacattacataaataaaactcactatagcttacatggctgatagatgaagacaagtaagatactccaggtccaggcatttagtaaaagtgatctcatttaaggctaacaataacactgtagagcaggcctagagaaactgaagttcagagacattaagtaacttggcccaagtcctcacagctagtagagagaagcaggaattaaattccacttctaactccaaacaccatgtcctgtcctcaacacctgccacaaaagtcattattcattcattgggcatttagagttacttaatccttaaaaaggtaactatttaatgtatttttttaagtcaggactactgagaaggctagaaattcatggtgagttaccaatgcattctgagcctataggcaaatttacatgaagagtatactttaatccaaagcttgctcaaccacagaggactctgagcaagtaaagtacaacaagggagctcagtggcctgctctgaggctcgcttccagagacagctggttgcctcatctcccaggaatactgggatctgg

SEQ ID NO: 1580 - DNA, 700 bp, Homo sapiens
ggctagaaattcatggtgagttaccaatgcattctgagcctataggcaaatttacatgaagagtatactttaatccaaagcttgctcaaccacagaggactctgagcaagtaaagtacaacaagggagctcagtggcctgctctgaggctcgcttccagagacagctggttgcctcatctcccaggaatactgggatctggttcggggcattctcttattggatgatgctggggatattcttctagtgtttgcctctatgattccaaaactgaccaactcttcttctaagacatttttacaacctacttttattattattatttcaaatgcagagacaaggtcttgctatgttgccctggctggagtggctattcacaggtgcaataacagtgcaatacaacttgaactcctgggctcaagtgttcctcccacctcagcctccaagtagctgagactataagtatgtaccaccatgcccagcagaacctaattttaaactaacatatgaagttattggaatgcttagacagcaattgcaagctttcataattgcaccaaaatgcatcctcgactttaacataatttattaaaattatactaatagtatagcttgtgatttgtatatgaacgtaaacgttcatatacaaatgaacctaaaaacagaaactttgtttactttgttccctaatgtatccccag

SEQ ID NO: 1581 - DNA, 700 bp, Homo sapiens
taacatatgaagttattggaatgcttagacagcaattgcaagctttcataattgcaccaaaatgcatcctcgactttaacataatttattaaaattatactaatagtatagcttgtgatttgtatatgaacgtaaacgttcatatacaaatgaacctaaaaacagaaactttgtttactttgttccctaatgtatccccagaacatgcaataggtgttcaatgttagctaaacgaaagagagatttgaaaaaaataattttaccaagagcaacagtcacaggtatcactgattgaatgtctgctatgttccagacactgtactaggtgctgctataaattctctctaatcctcacaaaagtatatactaagcaggaaattcaaaggacttaactgacttgtacaaaattgtatagttaagattgggagacaagataacaataagattagaaggcagggtatcataatgactaggctctgggtgctagaagaagtggacatttgtatgtaagaaagtaaacctcaacttttacctcatatcatattaagattctgaaatgaagcatatacttaattgtaagaactcaaactataaaacttttagaggaaaacactgaagaatatttttgtgacactgggtcaaagacttcctaaataataaacaaaaagtataaaccataagagaaaaaagtttataaact

SEQ ID NO: 1582 - DNA, 700 bp, Homo sapiens
tttgtatgtaagaaagtaaacctcaacttttacctcatatcatattaagattctgaaatgaagcatatacttaattgtaagaactcaaactataaaacttttagaggaaaacactgaagaatatttttgtgacactgggtcaaagacttcctaaataataaacaaaaagtataaaccataagagaaaaaagtttataaactgtacctgatcaaaatttaaaactcctgtcctctgaaaagcagttaagaaatatctgcaaaaccaatatctgataaagggcttgtatccagaacatatttagaactctctgcctggcactgtagctcacacctgtaatcccagcactttgggagactgaggcaggctgattgcttgagcccagaagtttgagaccagcctgggtaacctggtgagaccttgcctctacaagtctcaccggtgtggtgagtgtgtgcctgtagtcccagctacgtgggagactgaggtggaaggatcacttgagcctgggagtcagaggttgcagtgagccaagatcacaccactgcactctggcctgggtaagacagcgagaccctgtctcaaaaaacaagaaaaaaaaaaaaaaaaaaaagaactctcacagctcaataataaaatgaccaataaataaataacattgaaaaataggcaaaagacttttatattttactaacgaagata

SEQ ID NO: 1583 - DNA, 700 bp, Homo sapiens
tgagcctgggagtcagaggttgcagtgagccaagatcacaccactgcactctggcctgggtaagacagcgagaccctgtctcaaaaaacaagaaaaaaaaaaaaaaaaaaaagaactctcacagctcaataataaaatgaccaataaataaataacattgaaaaataggcaaaagacttttatattttactaacgaagatattcaggtggcaaataaatacatgaaaagatgctcaaaatcaataatcaattgactgatcaactaggaaaacacaaattaaaaatataaagaaatacaacctcacaatgtcacaatgagacactaccacacccctactgttatggctaaaatgaaaaagactgacagtactaagtggggatgagaatgcagagcaattacattcccataaattgttggtatattgttggtaggactatgaagtggtaccagatggtacagccatctggtaacttataaggttaaacatatatttaccacacgacctagcaacccgagtcctaaagttatccaaagacctgtatacagaagtttatagcagttttatctgtaacaacccaaagccgaaaacaacttatttctttttattatactttaagttcgagggtacatgtgcacaacatgcaggtttgttacatatgtatacatgtgccatgttggtgtgctgcacccattaactcg

SEQ ID NO: 1584 - DNA, 700 bp, Homo sapiens
acgacctagcaacccgagtcctaaagttatccaaagacctgtatacagaagtttatagcagttttatctgtaacaacccaaagccgaaaacaacttatttctttttattatactttaagttcgagggtacatgtgcacaacatgcaggtttgttacatatgtatacatgtgccatgttggtgtgctgcacccattaactcgtcatttacattaggtgtatctcctaatgctatccctcctccctccccccaccccacaacaggacccagtgtgtgatgttccccttcctgtgtctgtccaagtgttctcattgttcaattcccacctatgagtgagaacatgcggtgtttggttttttgttcttgcggtagtttgctgagaatgatggtttccagcttcatccatgtccctacaaaggacatgaactcatcattttttatggctgcatagtattccatggtgtatatgtgccatattttcttaatccagtctatcatcattggacatttgggttggttctaagtctttgctattgtgagtagtgctgcaataaacatacatgtgcatgtgtctttatagcagcatgatttataatcctttgggtatatacccagtaatgggatggctgggtcaaatggtatttctatttctagatccttgaggaatcgccacactgacaaatgggttctaattaaactaa

SEQ ID NO: 1585 - DNA, 700 bp, Homo sapiens
ttggacatttgggttggttctaagtctttgctattgtgagtagtgctgcaataaacatacatgtgcatgtgtctttatagcagcatgatttataatcctttgggtatatacccagtaatgggatggctgggtcaaatggtatttctatttctagatccttgaggaatcgccacactgacaaatgggttctaattaaactaaagagcttctgcacagcaaaagaaactaccatcagagtgaacaagcaacctacagaatgggagaacatttttgcaatcaactcatctgacaaagggctaatatccagaatctacaaagaactcaaacaaatttacaagaaaaaaacaaacaaccccatcaaaaagtgggtgaaggatatgaacagacacttctcaaaagaagagatttatgcagacaacagacacatgaaaaaatgctcatcatcactggccatcagagaaatgcaaatcaaaaccacaatgagatatcatctcacaccagttagaatggcgatcaataaaaatcaggaaacaacaggtgctggagaggatgtggagaaagaggaacacttttacactgttggagggactgtaaactagttcaaccaaaaacaacttaatgtccatcagccacagaatggatgaggaaaaaaattataatacatgcatacaatggaaggaatgctcctccacaataaaaa

SEQ ID NO: 1586 - DNA, 700 bp, Homo sapiens
agttagaatggcgatcaataaaaatcaggaaacaacaggtgctggagaggatgtggagaaagaggaacacttttacactgttggagggactgtaaactagttcaaccaaaaacaacttaatgtccatcagccacagaatggatgaggaaaaaaattataatacatgcatacaatggaaggaatgctcctccacaataaaaaggaatgaattgccgggcacagtggctcacacctgtaatcccagcactttgggaggccgaggtgggcagatcatctgaggttgggagttcgagaccagcctgaccaacatggagaaaccccgtctctactaaaaatacaaaaaaaattagctgggtatggtggcacatgcctgtaatcccagctacttgggaggctgaggtaggagaattgcttgaacctgggagacggaggttgcagtgagccgagatcatgccattgcactccagcctgggcaataagagtgaaactccgtctcaaaaaaaaaaaaaaaaaaaaggaatgaattactcacacatgcagcaacatagataaatcccagacacaaaagtctgcatactgtatgattctatatatgtgccactctctggaaaaggcaaaactataatgacagaaaacaaattagtggttactatggatgggagcaggggagaggactgactgcaaggactttgagagaact

SEQ ID NO: 1587 - DNA, 700 bp, Homo sapiens
aaaaaaaaaaaaaaaaaggaatgaattactcacacatgcagcaacatagataaatcccagacacaaaagtctgcatactgtatgattctatatatgtgccactctctggaaaaggcaaaactataatgacagaaaacaaattagtggttactatggatgggagcaggggagaggactgactgcaaggactttgagagaactttttggagtgactgaaatattctacatcttcattttagtgatggttatgctactgtatgcatatgtcctaactcatagaatttatactctaaaaagggtggattttaccatatatatattataccttaataaacttgacttaaaaagaaaaaaaggtataaacttaggaatcagaggactcaaatcctacctttaacccttatttccactgtgaatacctgtacctcagttttcctgcctatacaacctcacagttactatggagtttacattatacattttaaagcactcgggttagtgttaggcagtaaacattcaattaatgagaccatttgcaccacttgtgaaaaaaattctgtactcagaaaataccttttgagtagagtctaacaaatataactggatggatacttaagagcaatgaatactaacagctctactatgatactctacaaagtgctcagtttctttccatcagtgttttcactgcctcttggta

SEQ ID NO: 1588 - DNA, 700 bp, Homo sapiens
tgttaggcagtaaacattcaattaatgagaccatttgcaccacttgtgaaaaaaattctgtactcagaaaataccttttgagtagagtctaacaaatataactggatggatacttaagagcaatgaatactaacagctctactatgatactctacaaagtgctcagtttctttccatcagtgttttcactgcctcttggtagcacaaacattatgataatcatctgggcttggatctttcatgacatctctacctgcttcattccttaaatccagccagtcaccagatcccctgaattccttctttgacatctgtgttttggttctaatctcagagcacaaaacataggttctatccccagagtacacacctagtaaaaggagctaggacaagcaggcagacaacaataacaaaaacagccaagggtttaaagcttaggtgccagtgtgaaatgagataaaaaaaatagagcagctgggctatcaagtatagaaggaccatgaacttgtgtgcagaaaaaaaaagttagaaacatattcctctagcaattcccatttaaggcaagaaaggaaaacagatctaagtaggccaaaaaaagaggacaggatatggtgggatggtaataaagtagtttatgagagagtgagagttcccgaagataaagggaatcagtaaaaatgggaaaggatgcattctagtg

SEQ ID NO: 1589 - DNA, 700 bp, Homo sapiens
atgaacttgtgtgcagaaaaaaaaagttagaaacatattcctctagcaattcccatttaaggcaagaaaggaaaacagatctaagtaggccaaaaaaagaggacaggatatggtgggatggtaataaagtagtttatgagagagtgagagttcccgaagataaagggaatcagtaaaaatgggaaaggatgcattctagtgcatggttgaaaggacgtagtcttttctgggaaggtgatttgacccaaactttaattgggttctatgaagggaagaatcttcacatgtcagagctaaaaaaaaggactttggaagtcatctacttaataaacatttattgaaccacctgctatgtgccaggcactaggctaggctctgaggatacagagaagaatattaaacccttggagaattactcacaattaaacacaaacaagtaaataaatacctcaacctctgctacagccttggttagaatcttggcaccactcactaaatcctaggtattatcatttagccctaccttgacatcatttccaatataaatgcttcatttcaacaatatggatttccttgacagtgttcaaagacagcttggattttactgtctctatgtctccaatgacttactcatttatgatcaaaaaagtcatggccaaattcagtcctatgaaatcctctctggctacctcagatagaa

SEQ ID NO: 1590 - DNA, 700 bp, Homo sapiens
ctaggtattatcatttagccctaccttgacatcatttccaatataaatgcttcatttcaacaatatggatttccttgacagtgttcaaagacagcttggattttactgtctctatgtctccaatgacttactcatttatgatcaaaaaagtcatggccaaattcagtcctatgaaatcctctctggctacctcagatagaaattctctttctttatcctcagagctcctacaggtcttgtttttttctctgccttaccattacatgtgcttgtcatctctccaaccaagatgctcctcaagaaaataaaacgtggagtggggcaagggggaaagaagaaaaaaaaaggaaatctgttctaatatcttggtaattaccacgggacccacacagagttatcaggacaactcatcctaaaatataacatagtcttccactcttctgtctattgaactaagtctgaaatccattagctttctataatctgaccccgattcatattggtcatttactccttttatattgatttacttaacccagactcttcctctcataatcctgttctgattaagcttgtaaaggtaaatatgcacatacatacaagtgaatgtttgtatatacatatgtattgtatatatgcagttaaaaaaagttgcaggtaaaatatactctggaaggttagagatgagaaatggaagact

SEQ ID NO: 1591 - DNA, 700 bp, Homo sapiens
ttggtcatttactccttttatattgatttacttaacccagactcttcctctcataatcctgttctgattaagcttgtaaaggtaaatatgcacatacatacaagtgaatgtttgtatatacatatgtattgtatatatgcagttaaaaaaagttgcaggtaaaatatactctggaaggttagagatgagaaatggaagactatcttttacttttcacctaatatccttttataacttttttactaggggcacatattacttttaaaagaaaagtcaaaataaatacaaacatttccaggtgcggtggctcacgcctgtaatccctgcactttgggaggccgaggcgggcagatcacttgaggtcgggagttcgcgaccagcctgaccaacatggagaaaccccgtctctactaaaaatacaaaaaattctattttttttttttatttagccgggcgtggtggctcatgcctgtaatcccagctaccctggaggctaagtgggagaattgcttgaacccgggaggcagaggttgcagtgagccgagatcgtgccactgcactccagcctgggcaacaaaagtgaaactccatctcaaaaataaataaataaataaatacaaacatgtataaaatgtcttctagtttgctgacttgatttcttcccattcttcaaggcccacctcagccctacctcctccca

SEQ ID NO: 1592 - DNA, 700 bp, Homo sapiens
gggagaattgcttgaacccgggaggcagaggttgcagtgagccgagatcgtgccactgcactccagcctgggcaacaaaagtgaaactccatctcaaaaataaataaataaataaatacaaacatgtataaaatgtcttctagtttgctgacttgatttcttcccattcttcaaggcccacctcagccctacctcctcccagaagcccttgcaatatatttctatgcatggccatcattaaaaatatatatatattttctacttcatgattcaaagatctatactggtatttacaggtgagttttttaaaaaccaaatcaataaattttttaatgactttaaaaaatctactatctaaaacatagcaaatagccatttttaagaatgctcttatttagactaggaataccttaaggacaggggtgcagttgtagtcctctttgtacccaagcacagtataccctggtacaaagaagacacccaataaatgcttattaaatgaatgaatggaatttcctgtaggcctttcttataaatcaccgggttgaggaaggtatactcatttgcaaatatatgaacatgttatggatcaattccaaattctgtgcaatttttgaatgcttcaaaaactttctgcaaattttaaaaattctctagaaagatgtcaatttttaaaaatattaatacagaactgtaaggt

SEQ ID NO: 1593 - DNA, 700 bp, Homo sapiens
tgaatgaatggaatttcctgtaggcctttcttataaatcaccgggttgaggaaggtatactcatttgcaaatatatgaacatgttatggatcaattccaaattctgtgcaatttttgaatgcttcaaaaactttctgcaaattttaaaaattctctagaaagatgtcaatttttaaaaatattaatacagaactgtaaggttgggtaatgatattgctatttaacacctagtgatctatactactaatttagtgtgatgctacaaatttgttttctttcaaatccaagctctttcagcaatttaaagactaacatagacctaaaacattagctccctgataattcaagaaatatacaagccattcagtttcatatacaaataaggggagaatgctactatagcaaaaaaaggactacctatttagtatacaagaaattaactactgtacatcactgtgactttagttaataacaatatataattgctaagagagtagattttaagtgttctcaccataaaaaaattgaagtaatgaacgttaaatagcttgatttagccagtccacgatgtatacttatatcaaaacatcatgctgtataccataaagatatacaatttttgtcaattaaaaataaaatcaagttaccttcaatggatcaagttcattctcataggatttgacaatttcctttgaagatg

SEQ ID NO: 1594 - DNA, 700 bp, Homo sapiens
tttaagtgttctcaccataaaaaaattgaagtaatgaacgttaaatagcttgatttagccagtccacgatgtatacttatatcaaaacatcatgctgtataccataaagatatacaatttttgtcaattaaaaataaaatcaagttaccttcaatggatcaagttcattctcataggatttgacaatttcctttgaagatgttaactgggcttccttacttgtaatctgatcacgaatctcacaagctttttccttatattgcttcagatattttagttccatttgatattcttttactttctgaccttgtgtctgacgtacctgccgaagtgtttctaaggctttaatgtatctttgaagatatgaaacaaaaatcaaatttctggcaaagtaaattatggtatatattcatacagtgggatattatgctgtcactaagattacagttacaatgagtttttaataacttgtaaaatgcctatgacataatggtaagtgaaaaaaattacatttatactgtcaatcaggtaaataaatatacgcacagaaagacaagtgaaagaaaatatgcccaatggttgctgctggatgagaggtagtaactgatgacctttctgctttttaaattttttctgttaaaaagaagcatccaaattgcaaacacagttcaataacttaatggactacaaagtctattta

SEQ ID NO: 1595 - DNA, 700 bp, Homo sapiens
aaaaaaattacatttatactgtcaatcaggtaaataaatatacgcacagaaagacaagtgaaagaaaatatgcccaatggttgctgctggatgagaggtagtaactgatgacctttctgctttttaaattttttctgttaaaaagaagcatccaaattgcaaacacagttcaataacttaatggactacaaagtctatttaagggttacaaaccttgttgctgaaaaaatctcatcaaacttttgcttcaaagcctttccttcacttaaaggccaattagaatcttcttgatgacagaaaatgacattatttagcacagccttggaaaccccaagagaactgatcatttctcggtcaatttctgcacacttagagctcagactgaccttttcaccatgcctacagaaaatgaaaatcaagaatatatgtaaaataaccttcagtgtatctattctattgcttaatcaattcatactgtacttctttaaaagaataaaaaaaaaggcccttcacctatcccgttagaaatggcttcatcatgctaaaaagtgtaactcttaaactatttaacggttcacagatgaaaagatatgtaaaacaaagtagttcaggaaaggaagccagaatttattttttacatatttggacttttaaatataataatttagaatacttagagatactatatagagcattaact

SEQ ID NO: 1596 - DNA, 700 bp, Homo sapiens
  misc_feature (1)...(700): n = A,T,C or G
aaaaggcccttcacctatcccgttagaaatggcttcatcatgctaaaaagtgtaactcttaaactatttaacggttcacagatgaaaagatatgtaaaacaaagtagttcaggaaaggaagccagaatttattttttacatatttggacttttaaatataataatttagaatacttagagatactatatagagcattaactgtcttaaaaataagagacaaagaataaaacaaaacatgatgatcaatagcagacaggcaaaggtaagttaaaaacatcttagaatggggttctttcttcagtaacagactgctctggtgagcagaggcaatatctgtctttactgttttttatacatttcaatttgtattttgaaaatattacactgggccaggcacggtggctcatgtctgtaatcccagcaatttgggaggccgaggtgaatggatcacctgaggtcaggagttcgagaccagccagactaacatggtgaaaccctgtctctattaaaaatacaaaaaaattagccaggtgtggtggtgggcacctgtaatcccagctccttgggaggctgaggcaagagaatcacttgaactcggtgaggttgcagtgagnngagatnnnnncattgcactccagcctgggnnacnagagnganactcngtctcaaaaaaaaaaaaaaaaaaaaaannnnnagaaa

SEQ ID NO: 1597 - DNA, 700 bp, Homo sapiens
  misc_feature (1)...(700): n = A,T,C or G
gtctctattaaaaatacaaaaaaattagccaggtgtggtggtgggcacctgtaatcccagctccttgggaggctgaggcaagagaatcacttgaactcggtgaggttgcagtgagnngagatnnnnncattgcactccagcctgggnnacnagagnganactcngtctcaaaaaaaaaaaaaaaaaaaaaannnnnagaaaaaaaatnnnatnntgaatntnttaagnnngntttgcagagggntnnaatagacacagataaatcaataggttatcacatgaggtcatggaaagacaatggtagcttggactaggactagaatggtggttgtagagatggaaacagattccagagacatttagattaaattcataggtctcagtaatagactggatatggaaggcaaagacatatcaagacttaggttcttggcttttgtcactggacggatagtggtatcattcaccaaggtgaggtataccataagaccaagttgttggaggttttttaaggggggaggtcaaagagaaaggactgagtttggttttggaaacgttgaacctaagttgtctttgaaacaactggtaaaaaaaatcagagatggggctgggcgcggtggctcacgcctgtaatcccagcactttgggaggctgaggtgggcggatcacgaggtcaagagatcaagaccattctggctaa

SEQ ID NO: 1598 - DNA, 700 bp, Homo sapiens
ggaggttttttaaggggggaggtcaaagagaaaggactgagtttggttttggaaacgttgaacctaagttgtctttgaaacaactggtaaaaaaaatcagagatggggctgggcgcggtggctcacgcctgtaatcccagcactttgggaggctgaggtgggcggatcacgaggtcaagagatcaagaccattctggctaacatggtgaaaccccatctctactaaaagtacaaaaattagccaggcatggtggtgcacgcctgtagtcccagctactcaggaggctgaggcaggagaatcgcttaaacccgggaggcggaggttgcagtgagctgagatttcaccactgcactccagcctgggtgacagacagagcaagactccatctcaaaaaaaaaaaaaaaaaaaaaaaaaatcagaaatgggtaaataggtctgggtaaatgggtctggaaacagaggtctggtttggagatatgacataaatctgtgagtcatctatgaacacagagtagtttgagcaatggataagaatgtgattacctaggaagaaaatacagagcaaaaaaaaggagaagatacaggactgagcctaatgagacttccaacctttattgatggggtgaatgaagtagtatgtagctgtgatagaaagagagaacagtattgtatcatggaggtctagaaaaagaaattttc

SEQ ID NO: 1599 - DNA, 699 bp, Homo sapiens
ctatgaacacagagtagtttgagcaatggataagaatgtgattacctaggaagaaaatacagagcaaaaaaaaggagaagatacaggactgagcctaatgagacttccaacctttattgatggggtgaatgaagtagtatgtagctgtgatagaaagagagaacagtattgtatcatggaggtctagaaaaagaaattttcaaataaaaagtaataaactagcatttacttagctatggtacatggaacaatggtcctccaagatgtccacattttaatcccttgaatttgtgaatgttacattgcacagcaaaagagaattaagattacagatggaattagggtgttaatcatttgaccttaaaatagactatcctggattatttggatggggcaaatgtaatcacatgggtcctttaatgtgagagaggaaggcagaagaagagagaagaagaggtcacagtgatttgatatgagaagaactctgcccactattgcttgctttgaagacagagtaagagggcatgatctaaaaaatatgggtggcctctaaaagacggaaagaacaaggaaacatattctcccttagagcctccagaaaggaacgtaaccctactaacatcttgattttagcccagtgagacccaattcagacttctaaactacataagtgtaagataataaatttgtattgtttat

SEQ ID NO: 1600 - DNA, 700 bp, Homo sapiens
tgctttgaagacagagtaagagggcatgatctaaaaaatatgggtggcctctaaaagacggaaagaacaaggaaacatattctcccttagagcctccagaaaggaacgtaaccctactaacatcttgattttagcccagtgagacccaattcagacttctaaactacataagtgtaagataataaatttgtattgtttatagcactaagtttgtggtttcttatagcagtcatagaagactaatacatgaactcttactacatgttaagcattttatatgcattagctcaaccttgacaacatctaagatacacacagtgaaaatgaatgcctactttacaaatgaaataaacagaggctcactcttaggtctactttgtatagcagcagcattaccctaattaaaaacagagttattagtaactttagtcagaggtgtttcaaaggacgaatgggactgcaattggagtgaagaggaggtgaagaaatggagacagtatcaacaactcttttgagagactggctataaaggagaagaaggagacaggtagtaactggagtggaatgaaatcccagggtatgagagatacttgagtgtgttaaaatggcaatgatgaaaacctgcttgagaagccagtatagtgcctccagcacatagtagatgtgcattattggttaaataaaggaattacttagctag

SEQ ID NO: 1601 - DNA, 700 bp, Homo sapiens
tcaacaactcttttgagagactggctataaaggagaagaaggagacaggtagtaactggagtggaatgaaatcccagggtatgagagatacttgagtgtgttaaaatggcaatgatgaaaacctgcttgagaagccagtatagtgcctccagcacatagtagatgtgcattattggttaaataaaggaattacttagctagttaaataaaagggaggagaagaagctgaatagtcaagtaatttgctcaacaaagacagagacttgaatctaaggtagtctaatccccaaatccatatccattagaaaatgatacctgcctctaacagaatgataatggttgaaaggaacaatttatcattctttcctacttgtctgcttctcatctcacccattcttaaacatgacactagaattttttactcattcaacctgtatttgagtgattatgtgctttcaattcagcaactgttcagaaattactcaagagaatggaacataaccctaagtctttcatgggatcattctatttaactgacaaatagtatccacaaaaaatcaaatgttcatagtggaggaggctgtgtgtgcgtgggggtagggagaaaatggaagctcagtactttctgcccaattttgctataaacccaaaactgctctaaaaaaataaagtctaaagtctattgaaaaaaatttaatat

SEQ ID NO: 1602 - DNA, 700 bp, Homo sapiens
aaccctaagtctttcatgggatcattctatttaactgacaaatagtatccacaaaaaatcaaatgttcatagtggaggaggctgtgtgtgcgtgggggtagggagaaaatggaagctcagtactttctgcccaattttgctataaacccaaaactgctctaaaaaaataaagtctaaagtctattgaaaaaaatttaatatgctcccctaaacttatagtagaaaacaaccatcaacttacagacctaaaagactgaaaatgaacagaaattcaaatatcatataaacacctactttgttctagtaatgactccttccagagttttaaattctgtctttttgcttttctgagtacacaccatagatctttgcacagctataagttctccattgacatcacgaaattgcagacgaatctgggctctcacatctgtttcttgagcaacctttgaaggaaaacacagaaaaaacttatgttactttaataagcaccagtgttggttctgagaaaaaggcataagcaatcttacccaaaatgagggaacaaaaagaaaaacatccaaaatgagtgatatttttacatgctatccaaaatatagaagaatactgtttaattaatttacaaaaatgatatactatctacctcctttattcagcatcattaggagatcaggtatgcagatttttcaaataaatgaat

SEQ ID NO: 1603 - DNA, 700 bp, Homo sapiens
ggttctgagaaaaaggcataagcaatcttacccaaaatgagggaacaaaaagaaaaacatccaaaatgagtgatatttttacatgctatccaaaatatagaagaatactgtttaattaatttacaaaaatgatatactatctacctcctttattcagcatcattaggagatcaggtatgcagatttttcaaataaatgaattttatctctgtaagcatcaaaaatgttttttatccttaaaaattgcaagtttatagaaaggtagaatgatttggtttgtctttgtctccacccaaatctcatcttgaatttccacatgttgcaggaggtacccagttgaaggtaattgaatcatggggacaggtctttcccatgctgttcttgtgacagtgagtaagtctcacgagacctgatggttttataagaaggagtttccccgcacaagctctctttgcctgttgctgtccatgtaagatgtgacttgcgcctccttaccttccaccatgattgtgaggcctcccaagccaggtggaactgtagtccattaaaccctttcttttgtaaattgtccagtctcaggtatatctttattagcagtgtgaaaacggactcatacagtaaattggtaccaggagtggagtgctgctgaaaagttatccgaaaatgtgaaagcgactttggaactgggtaacaggcagag

SEQ ID NO: 1604 - DNA, 700 bp, Homo sapiens
caccatgattgtgaggcctcccaagccaggtggaactgtagtccattaaaccctttcttttgtaaattgtccagtctcaggtatatctttattagcagtgtgaaaacggactcatacagtaaattggtaccaggagtggagtgctgctgaaaagttatccgaaaatgtgaaagcgactttggaactgggtaacaggcagaggatggaacagtttagaaggctcagaagagaggaaaatatgggaaagtttggaactccctagagatttgttgaatggcattgaccaaaatgctgatgaggatatggacaatgaaatccaggttgaggtggtctcagatggagataaggaacttgttgggaactggggcaaaggtgacttttgttatattttagcaaagaaactggcagcattttgcccctgccctaggaatgtgtggacctttgaacttgagagagatgatttagggtatctggtgaaagaaatttctaagcagtaaagcattcaagcggtgacttgggtgctgttaaagggatgcagtattaaaagggaaacagcataaaagtttggaaaatttgcagcttgacaatgtgatagaaaataaaatcccattttctgaggaggaattcaagccagctgcagaaatttgcataagtaacaaggaaccaaatgttaattaccaagacaataaggaaaatgtct

SEQ ID NO: 1605 - DNA, 700 bp, Homo sapiens
cattcaagcggtgacttgggtgctgttaaagggatgcagtattaaaagggaaacagcataaaagtttggaaaatttgcagcttgacaatgtgatagaaaataaaatcccattttctgaggaggaattcaagccagctgcagaaatttgcataagtaacaaggaaccaaatgttaattaccaagacaataaggaaaatgtctccaggggcatgtcagagacctttgtgacagcccctcccatcacaagcccagaggtttaggaagaaaaaatagtttcgtgggccaggcccagggtccctctgctgtgtgcggtctagggacttggtgccctgtgtcccagccacaactaaaagaagccaaggtacagcttggcctgttgcttcaaagggtggaagcccgaagccttggcagcttccacgtggtgttgagcctgcaggtgcacagaagtcaagaaatgaggtttgggaacctctgcctagatttcagagggtgtatggaaacacctggatgcccaggcagatgtttgctgcaggggtggggcccttatggaaaacctctgctagggcaatatggaagggaaatgtggggttgaaaccccacagagttcctatggaggggactgcctagtggagctgtgagaagacagccactgtcctccagactggtagatcccccagaataatagatccactgacagctt

SEQ ID NO: 1606 - DNA, 700 bp, Homo sapiens
acacctggatgcccaggcagatgtttgctgcaggggtggggcccttatggaaaacctctgctagggcaatatggaagggaaatgtggggttgaaaccccacagagttcctatggaggggactgcctagtggagctgtgagaagacagccactgtcctccagactggtagatcccccagaataatagatccactgacagcttgcactgtgcacctggaaaaactgcaggcactcaacaccagcctgtgaaaacagccaggaaggaggctataccctgcaaagccagaagtggagctgcccaaggccatggaagcccacctcttgcatcagagtgacctggatgtgagacatggagtcaaaggagatcattctggagctttaagatacacctgccccactgaatttcggacttgcacggggcctgtagcccctttgttttggccaatttctcccatttggaatggctgtatttgcccaatgcctgtatccccattgtatctaagaagtaactaacttgcttttgagtttacaggcgcataggcagaagggacttgccttatcttgggtaagactctggactgtggacttctgaattaatgctaaaataagactttgggggactgttgggaaggcatgattggttttgaaatgtgaggacatgagatttgggaggggccaggggtggaatcatatggtttggc

SEQ ID NO: 1607 - DNA, 700 bp, Homo sapiens
aagaagtaactaacttgcttttgagtttacaggcgcataggcagaagggacttgccttatcttgggtaagactctggactgtggacttctgaattaatgctaaaataagactttgggggactgttgggaaggcatgattggttttgaaatgtgaggacatgagatttgggaggggccaggggtggaatcatatggtttggctgtgtctccactcaaatctcatcttgaatccccatgtgttgtgggagaaaccaggtgggagataattgaatcacgggggcaggtctttcctgtgctgttctcatgatagtaagtctcacgagatctgatggtcattataagggggaattttcctgcacaagctctcatttgccaccatgtgagacatgactttcaccttccaccatgattgtgaggcctccccagccacgtggaactgtaagtccattaaacctctttcttttgtaaattgcccagtcttgggtatgtctttaacagcagtgtgaaaatggagtaatacacagaactacagtatacatagctttcctgccccccaaaccacatgagagtaagttgctgatctgatgtcccaacaccagtatttcctacaaaacaaggacattttcaacaacaaaaatcaggaaactgatactgatatattattaccacatggtccacaaatcccattcaagttttgcca

SEQ ID NO: 1608 - DNA, 700 bp, Homo sapiens
agtgtgaaaatggagtaatacacagaactacagtatacatagctttcctgccccccaaaccacatgagagtaagttgctgatctgatgtcccaacaccagtatttcctacaaaacaaggacattttcaacaacaaaaatcaggaaactgatactgatatattattaccacatggtccacaaatcccattcaagttttgccagttgttccaaaatgtgataagttaccattaactcagctgtggcatataaaataatggttctccaaagatgtccacattctaatcccttgaatttgtgaatgttacattacacagcaaaagagaattaacattacagatggaactggggtgtcaatcacttgactttaaaatagaaagattaccctggattatttgaatgaggcaaagtatctacaaaaagttagatgctgatagtagaggaggttgtgtgtgtacaggcagggaatatacagaaactgtactttctgctcaattttgctataaacccgaagctgatctacaaaataaagtttaaagtctgttgaaaaaaatttaatatgctcccttaaagtagtagaaaatgaccatcatcttataagacctaaaagaccaacaatgaacagacattcaaatatcatataatcacctattttttctgatgtcttctgtcttatattaatatggtcacttcagcattctt

SEQ ID NO: 1609 - DNA, 700 bp, Homo sapiens
tataaacccgaagctgatctacaaaataaagtttaaagtctgttgaaaaaaatttaatatgctcccttaaagtagtagaaaatgaccatcatcttataagacctaaaagaccaacaatgaacagacattcaaatatcatataatcacctattttttctgatgtcttctgtcttatattaatatggtcacttcagcattcttttcattagctggcacggtatattttttccatccttttgttttaaacccatctgtactattatatataaaaacactgttattccttttactttatttagggttttttggttattgtcctccatttttctcatgtttttatttttatgtttttatttatatctatgaacatagttataagatttataataagattttaaggttcttatctactaattctatcatctattcatccctagggtacttctgtggatgccttcctcactcagtcctacctaatggcttttggactgaattaatcaggaatgaataactattcatccattagttatgctgagagtttttatcatgaatgagtattaaattgaaaagctttttctgtatctattgatgctcatatgatttttcttctttattctattactgtggcaaattatactgattgtttttttctttttctacagcctaattcacttgtcccagtacgtcctttagagcaaaa

SEQ ID NO: 1610 - DNA, 700 bp, Homo sapiens
aggaatgaataactattcatccattagttatgctgagagtttttatcatgaatgagtattaaattgaaaagctttttctgtatctattgatgctcatatgatttttcttctttattctattactgtggcaaattatactgattgtttttttctttttctacagcctaattcacttgtcccagtacgtcctttagagcaaaaggattcagttcagaattacactttgtatttggtggttatgtctctttactttctttcagcctgaaatagttgctcagattttccttgactttcatgactgataattttgaaaagtacagaccattattttgcagaatacctcccaaaatttgggtaatatttcctcacgactagaatcaggttatgtatctttggcaagaatattatacaagcgatgatgagttccttttactgcatctcatcagacaggacatcatttccatttatctcattacggagggtattaacttcaatccctttatttatttttttgagacagggtctcactttgtcatccaggctggagtgcagtggcatgaacacagctcactgcatccacgacctctgagtcataagcaatcctcctacctcagccccccaagtagctgggactataggtgcatgccaccacaccccgccaatttttgtagtttttgtagagatgtggtttcaccatgtt

SEQ ID NO: 1611 - DNA, 700 bp, Homo sapiens
ttatttatttttttgagacagggtctcactttgtcatccaggctggagtgcagtggcatgaacacagctcactgcatccacgacctctgagtcataagcaatcctcctacctcagccccccaagtagctgggactataggtgcatgccaccacaccccgccaatttttgtagtttttgtagagatgtggtttcaccatgttgcctagactaacttcaatctcttgataaaggtgtatctcctagcttcaccaaaaaatttttctttacaattaattaataatttgagggagagatgcagagaccatacaactatctcatacttcatcaaactttcttccattagttttagcatctactgtttcttacctgaatgaattattattatgacagctatcaaatacaggcataccccatcttattgtgctcttcagaggtttgtggcaaccctgcatctaacaagtctatcggtgccatttttccaacagcatgtgctcactttgtgtctctgtgtcacattttggtaattctcacaatatttcaaactttttcattattattgtatctgttatagtgatctgtgataagtgatctttgatgttactactgtaattgtttgtgtgccacaaaccatccacatataagaggtgaacttaatccattaacgtgtgtgtcctgactgctttactgacctgccattcc

SEQ ID NO: 1612 - DNA, 700 bp, Homo sapiens
tgtgtctctgtgtcacattttggtaattctcacaatatttcaaactttttcattattattgtatctgttatagtgatctgtgataagtgatctttgatgttactactgtaattgtttgtgtgccacaaaccatccacatataagaggtgaacttaatccattaacgtgtgtgtcctgactgctttactgacctgccattcccgtctctctccctctccttggaacctgattgcctgagacacaataatatggaaattaggccaattagtaaccctacaacagcccctaagtgtttaagcgaaagaagagtcaaacatctcgttttaaatcaaaaactagaaatgattaagcttagttgagaaaagcatgtcaaaatccaaaacaggttgaaagttaggcctctttcatcagttagctgagttgtgagggcaaaggaaaagttcttgaataaaattaaaagtgctactttagtgaacacacaaatgataagaaagtgaaacagccttactgctgatatggagaaagttttagtagttgggatagattaaaccagccacaacattccctcaggccaaaacctaatccagagcaaagccccaactctctgcaattctatgaaggctgagagaagtaaagaagctgcaaagaaaagttggaagctagcaatggttggttcatgaggcttaaagaaagaagctgt

SEQ ID NO: 1613 - DNA, 700 bp, Homo sapiens
cagccttactgctgatatggagaaagttttagtagttgggatagattaaaccagccacaacattccctcaggccaaaacctaatccagagcaaagccccaactctctgcaattctatgaaggctgagagaagtaaagaagctgcaaagaaaagttggaagctagcaatggttggttcatgaggcttaaagaaagaagctgtctccacaacataaaagtgcgaggtgaagcagcaagtgctgatgcaggagctgcagcaagttatccagaagatctagctcaggtaattgatgaaggtagctacactaaacaacagattttcaatgtagacaagaccgccatccattagaacttaacctgcaatatctaaggtatgcctatagtaattttctagttccattattccttttatattagttaaggttctagtataaggggctttgctctttctccatttccccccccattttcttgtatcagtataaactcatagattccttacttgggctccaatcccccaccaggctgtcacagcttgtttttgtggatgccttcctcactcagccacacctaacggattttggactgaattattcaggaattaatattcctccatcagttatgctgagggtttttaccacgaaagactattaaattgaaatgcgttttctgtatctattggtgttcatatgatatttctt

SEQ ID NO: 1614 - DNA, 700 bp, Homo sapiens
acttgggctccaatcccccaccaggctgtcacagcttgtttttgtggatgccttcctcactcagccacacctaacggattttggactgaattattcaggaattaatattcctccatcagttatgctgagggtttttaccacgaaagactattaaattgaaatgcgttttctgtatctattggtgttcatatgatatttcttttttattctgttaatgtggcaaattatactgattggtttcttttctaccgtatctctctaagcattatctagctgcaccccacatatttttacatgctatatttttgattcatttaaagtattttttctaatttcccttgtgattccttttttgatccatgtaatatttagaagtatgctgcttaatttttcaattatttggggattttccggatacttttctgctactgattctggtgtagtcacagaatacattatctatgactttactccttataaatttattgacacttgttttacagtccagaatgttggtctatcttacagaatgttccacatgcacttgaaaataaagtgtattctgctatcgttcaatggaatgtcctataaatgtcaatcaggttgatttggttaacagtgttgttaaaattttccatatacttactgatatttcatctgcttcttttctctactgagaggggtattgagatctccaatt

SEQ ID NO: 1615 - DNA, 700 bp, Homo sapiens
acagtccagaatgttggtctatcttacagaatgttccacatgcacttgaaaataaagtgtattctgctatcgttcaatggaatgtcctataaatgtcaatcaggttgatttggttaacagtgttgttaaaattttccatatacttactgatatttcatctgcttcttttctctactgagaggggtattgagatctccaattgaccttgcagatttgtgtatttctccattctgttccataggtttctgcctcatatatttggaagttttacatttagaatttttgtgtccttgcattaaattgacctcttctcatcataaaatgtttcattttccctagttctgatgtcttctgtctggtattaatatggtcacttcagctttcttttcattagctggcacagtatattttttcaatccttttgcttttaacctatttgtaccattatatacaaaacaccattattccgtttatttgggtttttaaaattattttccatttttctcattatgcttatgttttcctttatatctatgagcatatttataagagttataataaggttttagggttcttatctactaattctattatttctttcattttggatctgttcatatgattgatttttctctgattatgggtcctatttccctgcttctttggatgcctgttaacttttgattgtgaattttgtatt

SEQ ID NO: 1616 - DNA, 700 bp, Homo sapiens
ttttctcattatgcttatgttttcctttatatctatgagcatatttataagagttataataaggttttagggttcttatctactaattctattatttctttcattttggatctgttcatatgattgatttttctctgattatgggtcctatttccctgcttctttggatgcctgttaacttttgattgtgaattttgtattgttgggtgaaagattttgttttattcctttaatgagtactgaactttgttctggcatgcagttaagttttttgagcaacaaacagttggattcttttgaacctttgttgttaaggtctgtaaagggggacctagagcagcttttactctaggactaatttacaatcattttcgacattttccttcagcctcaaaaactttctttaacaattactatagtgcaagcctgtctgtaacaaattacctctaccattttgttttaaatctgaaaatgtcctccatttcacctccaattttcaaagaatatttttgctggatataggagtttaacttttattccctagcaccttaaaggtgctgtcccactgttttcaggtttagattgcttttcctaagaagtaatcatactcattattctttccctctgcatgatgtgttactttttcctccacctgtttttaagattttatatttagttttgaacaatttgaatgtaatgt

SEQ ID NO: 1617 - DNA, 700 bp, Homo sapiens
aagaatatttttgctggatataggagtttaacttttattccctagcaccttaaaggtgctgtcccactgttttcaggtttagattgcttttcctaagaagtaatcatactcattattctttccctctgcatgatgtgttactttttcctccacctgtttttaagattttatatttagttttgaacaatttgaatgtaatgtacaacatagttatgtttatgctgcttgtgatgcattcagcttcttgggtctttttttatagtttttattactctgtttagatgtcttcccacacattatgtccatcttttcctttaagtccttgagcttatctatcatagctttaaaaaaatccggtcgggcgtcgtggctcatgcctgcaatcccagcactttgggaggccgaggcaggcggatcacaaggtcatgagttcgagaccaggttggctaatatggtgaaaccccgtctctactaaaaataaaaaataaaaaaataaaaaatcagccgggcatggtcgtgggcacctgtagttccagctactcgggaggctgaggcaggaaaattgcctgaacctgggaggcacaggttgcagtgagccgagattgtgccactgcactccagcctgggaaacagagtgagactccatctcaaaaaaaaaaatttaaaaaaaatttaaaaaaaaatccttgtctgctaattc

SEQ ID NO: 1618 - DNA, 700 bp, Homo sapiens
atcagccgggcatggtcgtgggcacctgtagttccagctactcgggaggctgaggcaggaaaattgcctgaacctgggaggcacaggttgcagtgagccgagattgtgccactgcactccagcctgggaaacagagtgagactccatctcaaaaaaaaaaatttaaaaaaaatttaaaaaaaaatccttgtctgctaattccaaaatctgtcatctctggatctgcttctactcacttttcccttctcaggtatagaccacattttcttttgcatattcccattaatttttaaaattatattctgcacattgtagatgccacattgagagcttcgactgagtaggcttcctttaaaaagtcttgagttttgttctagcagccagttaatttactggcaactcagcttgattctatcaaaacctggtttcagtatttgttaggtgggcctttctgaggtctcaagtgaacactggagagttccacaaggtcactccattctggcacatcaggactcaaatgtctcacagcattgtgtgacctttagaatacaacactcacagccccacttgccaccttggtagttgttctctactagccctcattaaatctcatcctatacatggatagcttagtatttggccaaagactcaaaagatccttatgcagatttctggtacaccatctctgcacaacaaccct

SEQ ID NO: 1619 - DNA, 700 bp, Homo sapiens
tggcacatcaggactcaaatgtctcacagcattgtgtgacctttagaatacaacactcacagccccacttgccaccttggtagttgttctctactagccctcattaaatctcatcctatacatggatagcttagtatttggccaaagactcaaaagatccttatgcagatttctggtacaccatctctgcacaacaaccctacttcagtactctgctctacaatttccagtcactttagcaaatccaaaatcctatctttgtttcatctgcctagtgatgcccaattctgcccagctctctactggattccaattccatgtgccaaagtttacaaagtgttcccaggtagaaagctggaatgaatgcagaatcaccttttatgtttctcctttctcaaagaatatagccctgcattatctgtggtccaatgcctgaaaatagttgtttcacatacttttccagtgttacagttattcatcttgcgagtataagtgtgatactcattattttgttgcaacccaaatcacaagtactggattctgctttaaaaaaaaaaaatcattaaagatcctttgctgactttttaatgacttcttggcatgaatttaactttgatactaattcaattaatcattcaacaaatatttacaggcactttgtaggtttcatgtgttgttttggttcaaactgacagacttt

SEQ ID NO: 1620 - DNA, 700 bp, Homo sapiens
actcattattttgttgcaacccaaatcacaagtactggattctgctttaaaaaaaaaaaatcattaaagatcctttgctgactttttaatgacttcttggcatgaatttaactttgatactaattcaattaatcattcaacaaatatttacaggcactttgtaggtttcatgtgttgttttggttcaaactgacagactttttttcctttgaagcatgcaagataggttaaatgtagacaaggtgtgctaaacaccatcataagcacaggataatctgggagtacaaagcaggagcatctaacctatctaggacagctcagggaaggtagtctaaaggaagtgaatgtttaaatgaaacttctaccaatctgggtagaagttaaccagatgagaagatctgagtcactacgtgactacagaaatttcagaatgtttggcatagaaagtagggaaaagaagagtatcaacctaaaatgtttcagaaattaacagccttctaaacttggtaaggcttttggatttaaggtgatggcactaaatggtttgaaccaggggaattgcatgaagtagatatgcattttagaagaattattttgtctttagggtgaacagagtgaactgagacaagacatgaagcagggaataatcgaggagagataggaaggcagcctggacaagggttgaggatggaggtaaaga

SEQ ID NO: 1621 - DNA, 700 bp, Homo sapiens
aaacttggtaaggcttttggatttaaggtgatggcactaaatggtttgaaccaggggaattgcatgaagtagatatgcattttagaagaattattttgtctttagggtgaacagagtgaactgagacaagacatgaagcagggaataatcgaggagagataggaaggcagcctggacaagggttgaggatggaggtaaagaggaagaagtcgctgaactggctactcagaaacagcctcttaggatacagacatttcaatgaggaggtggccagaggtcagtataaagctttgaaagcccagacttgactctgtcatttcatcataaggagagcattctgctgaaggtttaatccacagtagttgaactaaggagctatgtatttatgcagcaaaaaattaatttgtttacagtgttcctgagtagcaagccaaatacacatactctttctccatggcatctacttttcgaggacctagctacccggcaaacatcaaattagtaaatagaattcaagcaagggctatcttgtagcatttctatcactacattgttgttgacactcttattgaagaagagtcacttcaaaagtgaagtgtaatttagattgaattattaaaacaaagaaatgtgtattatacttcagaacaatttctatcaaaaagaataaaataaaaaataagaaaaacccttctttctc

SEQ ID NO: 1622 - DNA, 700 bp, Homo sapiens
tagtaaatagaattcaagcaagggctatcttgtagcatttctatcactacattgttgttgacactcttattgaagaagagtcacttcaaaagtgaagtgtaatttagattgaattattaaaacaaagaaatgtgtattatacttcagaacaatttctatcaaaaagaataaaataaaaaataagaaaaacccttctttctccaaacaatctagttgtaaaaccattaggtggggcagaagaaggtgcgtgttcatgccagctgaaggttaaggcacctataactcagcctagagtggaataaatgagcttgagtaggctgagaagggtaccctcatggggaaacagcttggcatagacagagtttcaagagtccaatggtatcagagttccagcaggatgaaagaggaatccacaaataggggggatccagctcagaagcagagtgtccacgccagggaatagtgtggggattcagagcctgataatgatgagaagggggcccacctgagggttaagtcggctagggggaagtcagatcatagagtagagacggcattcttgcaagaagccacctggtataaagtatcagactgagaagagtgaccctctcagtgacacagatctggggagattcaggtcagagtacagtgggcatccctgcaagaggccacctggtatcagagaagggcggggaatgag

SEQ ID NO: 1623 - DNA, 700 bp, Homo sapiens
gcccacctgagggttaagtcggctagggggaagtcagatcatagagtagagacggcattcttgcaagaagccacctggtataaagtatcagactgagaagagtgaccctctcagtgacacagatctggggagattcaggtcagagtacagtgggcatccctgcaagaggccacctggtatcagagaagggcggggaatgaggacatgatctagcaccagaagtcaaagtgtatacagaatggaaaagcatcccatgagggagtcagaatgaagagtcaagagcctacgcaggataaggaagactggcatacagggatggagtcagcccatatgaggtgctagggccctgatgcaacgatgagacattgattacatacaggaggattgattaagtcaatatattaagattatggttgtataagtacattcttgcactgctataaaaaaaaaacctgaaactgggtaacttataatgaaaggaggtttaattggctcacagttccacatgctatacaggaagcaagactggggagacctcaggaaacttacaatcatggcagaaggcaaaggggatgctggcacatcttacatggctggagcagaagaaaaagagtaaagggggaattgtgacagatttttaaacaaccagatctcatgagaatttactcactatcatgagaacagcaagggggaaatctac

SEQ ID NO: 1624 - DNA, 700 bp, Homo sapiens
ttccacatgctatacaggaagcaagactggggagacctcaggaaacttacaatcatggcagaaggcaaaggggatgctggcacatcttacatggctggagcagaagaaaaagagtaaagggggaattgtgacagatttttaaacaaccagatctcatgagaatttactcactatcatgagaacagcaagggggaaatctacccccatgatccaatcaccccaaccaggtccctcctgcaacaagtcctgcagacttctgcctggacatccagacgtttccatacatcccctgaaatctaggtggaggctcccaagcctcaactcttgttctctgcgcaaccccaggcttaacaccatgtggaagctgccaaggcttacagcttgcagcctctggagcagcagcttaagatatatctggggcccttttagccatggctggagctggagtggctgaaacacagggagtagtgtcctgtaatgggaggggctgctgtgaagatctctgaaatgccttctagccattttccccagtgtcttggctattaaacattctgctcctctttacttatgcaaatttctgcagccggcttgaattcctccccagaaaatgggtttttcttttctaccacatgatcagggtgcaaattttccaaacttttatgctctgcttcccttttaaatataagttccagtttcagat

SEQ ID NO: 1625 - DNA, 700 bp, Homo sapiens
tctctgaaatgccttctagccattttccccagtgtcttggctattaaacattctgctcctctttacttatgcaaatttctgcagccggcttgaattcctccccagaaaatgggtttttcttttctaccacatgatcagggtgcaaattttccaaacttttatgctctgcttcccttttaaatataagttccagtttcagatctctttgcttgcacatatgagcatatactgctagaagcagccaggccacatgttgaaagttttgctgcctggaaatttcttccaccaaatactctaaatcatctctttcaagttcaaagttccacagattcctagagcaggggcacaatgctgccagtctctttgctaaagcatcgcaagagtgacctttactccagttctcagtaagctccttatctccatctgagacctcctcagcctagacttcattattcatatcactgtcagcattttggtcaaaataatttaacaagtctctaggaagttccaaacttttcctcatcttcctgtcttcttttgagccctccaaactgttccaacctctacccattacccagttccaaagtcacttccacattttcagctatctttatagcaataccctactctcggtaccaactttctgcattagtctgttttctcactgctacaaagaaatacctgaaactggttaaagaaa

SEQ ID NO: 1626 - DNA, 700 bp, Homo sapiens
aggaagttccaaacttttcctcatcttcctgtcttcttttgagccctccaaactgttccaacctctacccattacccagttccaaagtcacttccacattttcagctatctttatagcaataccctactctcggtaccaactttctgcattagtctgttttctcactgctacaaagaaatacctgaaactggttaaagaaaagaggtttaattggctcacggttctgcaggctgtacaggaagcatgactgcggaggcctcaggaaacttacaatcatggcagaaggtgaagaggaggctggcacatcttacacggccagaacaggaggaagagagtgaagggggaggtgctacacacttttaaacaatcagatctcatgagaacttactatcacaagaactgcaagggggaaatccacctccatgattcaatcacctcccaccaggcccctcctccaacaatgggggttacaatttgacatgagatttgggcagatacaaattcaaaccatatcggtactcaattccttgcttctcattaccttcatagtatttaccaaatccccaaccatggataaatgcaactttccaatttattcagtgcttgggctgaacaagactgaaaaaacatacataaccatgatggctggtctctctttaaattttcacaaaacccctgacactgtcatgtaatcccaga

SEQ ID NO: 1627 - DNA, 700 bp, Homo sapiens
aaattcaaaccatatcggtactcaattccttgcttctcattaccttcatagtatttaccaaatccccaaccatggataaatgcaactttccaatttattcagtgcttgggctgaacaagactgaaaaaacatacataaccatgatggctggtctctctttaaattttcacaaaacccctgacactgtcatgtaatcccagaacacctcccttaatcaatttacttactgaggttaaaaactattctatgttttctaggctcaatcaaccccttctgccactctcaaccagtaacttcatttcttttttcatttgagaatataaaagcaatcaaaagagaacttactcattctttcaccactaaagtttccaatcatataatctgcctaaatccctgttacaatggataacagtggatgttcctggtatcccctccagttgggcaatggatcttatctctttttgcctactcaagaattgtgctctgtaattatcccctctcctgcatcaatgtttctgtccagagtcattcccaacagtctacaaatgctctagtatatcccacttttaaaaacacaataaaacaacaacaacaaaactttcctttatcctgttaacctcttcagctactgtcctatgtctgtgtccacttacaacaaaattcataaaataattctgtttcacttctttatcttttctct

SEQ ID NO: 1628 - DNA, 700 bp, Homo sapiens
tcctgcatcaatgtttctgtccagagtcattcccaacagtctacaaatgctctagtatatcccacttttaaaaacacaataaaacaacaacaacaaaactttcctttatcctgttaacctcttcagctactgtcctatgtctgtgtccacttacaacaaaattcataaaataattctgtttcacttctttatcttttctctgattactggaactggttttgtcaagagcaacaacggactccacatatccaaacactcctcttctttcttgagctatcaacatatttgacacagttgatgatttcctccttataacactttattctcttgtcttccaagacaccactctctcagttttccttacttaacgaattgctcttttactagcttctcctcctcttcccaatttctaaaggcatcatcggctctagtgctctaggttaaggtcttgaatatcttttccatattcactctctatttgatctcatcaggctttaaaaattaactatgtggaactacctgtatacactaatgattcctaattttctttctccagtcctaatctctttcctgaacagacttctgcttgccaactggacatctcctttggatatttaacacatatccctaatttgcatgtttaaaccagatccacccaaatattttttccatagtgcccctattataataaatgacaaaa

SEQ ID NO: 1629 - DNA, 700 bp, Homo sapiens
aattaactatgtggaactacctgtatacactaatgattcctaattttctttctccagtcctaatctctttcctgaacagacttctgcttgccaactggacatctcctttggatatttaacacatatccctaatttgcatgtttaaaccagatccacccaaatattttttccatagtgcccctattataataaatgacaaaactattttatccagttgttcaagccaaaaactttggagttatgcttgatgcttttacttctttcatacaccattatccaaaccattagctaatttgttggttctatcttcaaaatacatcctaaatccaaacatttctcaccattctaccactaccttaatgaagccacctatatttctcacctggatcatcacaaaatcttcttaatttgtctctgccctatctttgctacctacggacagtcttctctcagcaaccagactgagcactttaaaagataaatcagaccatgtcctttccctgctcaaaatctcccaatagacagattcctatttaaataagactagaatccaaggacctacaggatctagtctctcctatctttctaactttattttctaccattttcccttgttcttccttgtcattccttgaacacaccaaccatgctcagggactctgcaactagactgaatgaaatgttttcttcccagattttg

SEQ ID NO: 1630 - DNA, 700 bp, Homo sapiens
cctgctcaaaatctcccaatagacagattcctatttaaataagactagaatccaaggacctacaggatctagtctctcctatctttctaactttattttctaccattttcccttgttcttccttgtcattccttgaacacaccaaccatgctcagggactctgcaactagactgaatgaaatgttttcttcccagattttgaacaactcattccctcttgaatgaatatttaaaagacaactctgattactctgtgagaaagagagagcttcaagaatgagggcaggaaaataagttaggagacgattctaatagttgaaagggaatatgatggtggcttggaacaggaacacagtggccgatggaatgaagtagacaaattctgacatattttagaagggtaggtaagaattgcttatgtagggatgatgacatcatttacaaaactggcgggggtggggtactgaggtagtaacagagctgagaatgtaggcaggaagtgggtacaaggaatcaagagttctgttttgaacatgttaaatttgagatgcccattaaatatccaaacaaacagctagacatatatgtctagagttaaggaaagaagtcagggtcaaatatataaatgtggtagttaccagcacataaccagtacttaaagccgttagactgaataagctcatccaagagagatagggaa

SEQ ID NO: 1631 - DNA, 700 bp, Homo sapiens
gtgggtacaaggaatcaagagttctgttttgaacatgttaaatttgagatgcccattaaatatccaaacaaacagctagacatatatgtctagagttaaggaaagaagtcagggtcaaatatataaatgtggtagttaccagcacataaccagtacttaaagccgttagactgaataagctcatccaagagagatagggaagagggttaatgcaaagatggccaactcttgtgtcacactggcttttagaaatcaagcaggttgggtgcagtggctcacatctgtaatcccagcactttgggagactgaggcaggtggatcacctgaggtgaggaggttgagaccagcctggccaacatgatgaaaccccgtctctgctaaaaatacaaaaattagctgggtgtggtggcacacccgtaatcccagctactcaagaggctaaggcacaagaatagcttgaacctgagagacagaggttgcagtaagccaagatcatgccacactgcactccagcctgggcaacagtgcaagactccgtctcataaaaaaaaagaaatcaagcaaaggtagacccaacaaagactaaagtatagccagtgagaaagaaggaaactatgagattatagtgtcacaaaagccaagaaggaaatatattttaaaaaagaaatagccaactgtgtcaaatctgacaagatgttaa

SEQ ID NO: 1632 - DNA, 700 bp, Homo sapiens
acactgcactccagcctgggcaacagtgcaagactccgtctcataaaaaaaaagaaatcaagcaaaggtagacccaacaaagactaaagtatagccagtgagaaagaaggaaactatgagattatagtgtcacaaaagccaagaaggaaatatattttaaaaaagaaatagccaactgtgtcaaatctgacaagatgttaatgagaattagaaactgaccactctatctggcacattgagattattggtgaccttacaaaggcacttttagtggaggaaaaaaagaaaacctgaatggagtagattgagggaaaaatgggagtcaatgaagtaaagacaatgaggacatacaaatcttatgaattttgaaatatattggaacagagaaaaggtaatggctagagggtaaattggagtaaagggagagttttttgtttgaagactagagataccagagcatgtttatatgctgatgtgaatgatccatcaagagaaactgctgatccaggagagagatggaaaaactgaagggcaaaatccttgggtggataagagggatcaatgagatctagcctccaaggagctggttcatgtttagataaaacaacaaataatttatccaagaaaaaacagtatgggcacgtatgtacagtagtttcgtagatgtgatgattggaaaataagggaattctcatttgat

SEQ ID NO: 1633 - DNA, 700 bp, Homo sapiens
ctgatccaggagagagatggaaaaactgaagggcaaaatccttgggtggataagagggatcaatgagatctagcctccaaggagctggttcatgtttagataaaacaacaaataatttatccaagaaaaaacagtatgggcacgtatgtacagtagtttcgtagatgtgatgattggaaaataagggaattctcatttgattcttcctatttctcaataaagtacaaagcaagatcatcaattaaggaaagtagattgtagatttaaggagagagaaggtgggaaacagtcattatggagaggactcagtaaatgtactaaatactattacatttctaagaggaaaattcataaatattttcataattacagagttatctttaatcacactaaggtagaaacaaataataatcaacagggggtcatttaataaactacaggatataaactcaatggaatacaatttactaattaaaaacaataaaatagaagtataaaattatattaatgtgctaaaatatgtatgtgtgaatgcatttatgtgctcacgtagacatggttttataagcagaaaaaagcttggaagaatacgtaacgaaaacatagtggaactggggtcagggagcggctagagaggcacatgaccccactaaaaacgaataaactatatatatatgtgtgtgtgtgtgtgtgtgtgtgt

SEQ ID NO: 1634 - DNA, 700 bp, Homo sapiens
ttatattaatgtgctaaaatatgtatgtgtgaatgcatttatgtgctcacgtagacatggttttataagcagaaaaaagcttggaagaatacgtaacgaaaacatagtggaactggggtcagggagcggctagagaggcacatgaccccactaaaaacgaataaactatatatatatgtgtgtgtgtgtgtgtgtgtgtgtgtattgttgtttcacttctatatgtgcaaaaacaaacctatagaccaaattctatgtcctttacacatacgaatagtataaacaccataattcaaacaatgattcatacacaaagatttttatcatgatacttttttttctagacagtgggtctcactatattgtccaggctagccttgaactcctgggctgaagcaatcctcccatctcagcctctagagctatctgggagtattggcacacacccccaagcctggcttatcatggtacattttaatgaaaaactgaaagcaatctaatgtaagaaaattacataactactaaagtgttcatgcactttaagtagaaaatatctcagacatacaaagcagtataaagattaaaagaaacacttacataccaaacacccagatgatagttttttaatgacataggacttcatgataatgttaagtggggaaaaaaacccagaatacaaaattaagagtatgacatcagc

SEQ ID NO: 1635 - DNA, 700 bp, Homo sapiens
atgtaagaaaattacataactactaaagtgttcatgcactttaagtagaaaatatctcagacatacaaagcagtataaagattaaaagaaacacttacataccaaacacccagatgatagttttttaatgacataggacttcatgataatgttaagtggggaaaaaaacccagaatacaaaattaagagtatgacatcagctatataaaacagtatttaaaggaggaggaaaacacatgaaaatgtcaacaacggttactactgggtgctaaaactgtgtggggctgactttcatttctctttatagttttccagtgccaagttttctataataagctattatcatttttataattataaaaatacaaaattgtactagcaccattaccttgggatcgtgtacaaatgtatttcctttggttccaggagggaaatctccagtacaaatatattttagacattcaatgatggtctaaagaaatagaaaattacattatttcgttataagagaaccacagaagtttaccataaaatatgaattcattacaaaaatattatttatcatggaaactataaaagataaaatctgacattataaaacctgtaataaaaatatgattaagtgttaatgctgtaagttcacagaaatgctatataactaagaagttatcctaatatgaagaattgttacttgggaaaa

SEQ ID NO: 1636 - DNA, 700 bp, Homo sapiens
cgttataagagaaccacagaagtttaccataaaatatgaattcattacaaaaatattatttatcatggaaactataaaagataaaatctgacattataaaacctgtaataaaaatatgattaagtgttaatgctgtaagttcacagaaatgctatataactaagaagttatcctaatatgaagaattgttacttgggaaaaaaataattattttcaactgaaaccctttaaactaatttaagttaataataagaatggctaacagttaagtactgtattgtactaagcactcttacatacatttatttaattctcacattaactccaggctgtaggaactttttgtttaagagacagggtctcattctgctgcccaggctgcagtgcagctgcatgatcatggcttactgcagcctcgacctctcgacctcctgggctcaagcaatcccccagcctcagcctcccaaacggctcggattacagtcgtcagccaccatgcccagcctgtagaaacttttttttttttttttttttttttgtggggggagagagtctccctctgtcacccaggctggtgtagtgcaatggcgtgatctcggctcactgcaacctccacctccccggttcaagcgattctcccgcctcggcctccccagtagctaggattacaggcatgcgccaccacgcctggctaattttt

SEQ ID NO: 1637 - DNA, 700 bp, Homo sapiens
ccagcctgtagaaacttttttttttttttttttttttttgtggggggagagagtctccctctgtcacccaggctggtgtagtgcaatggcgtgatctcggctcactgcaacctccacctccccggttcaagcgattctcccgcctcggcctccccagtagctaggattacaggcatgcgccaccacgcctggctaatttttgtatttttattagagatggggtttcgccacgttggccaggctggtctcgaactcctgacctcaggtgatccacccgcctcggcctcccaaagtgctgggattacaggcgtgagccaccgtgcccagctgtagaaactatttttaatctccattttataaatgagaaaactaaggcacagagcagtgaggtcactcgcaaacaatcagacaactaataaatgaagcgaaaaagctgtattgaggcagccagtcctcataaacactatacagtactactctcccttctgctagtatttagtacaatcctaagtacataacaagcattcaacaaataacatttttacaaaaacaaaagtaaacaagtttggcattcaattctcaaccttctctctttctacactcttcacaaatccttcctttagactcttctccctgctatactgacatcgtcttgctttttcttaagccactattcctgaccagaatgcctcttggttat

SEQ ID NO: 1638 - DNA, 700 bp, Homo sapiens
tacaatcctaagtacataacaagcattcaacaaataacatttttacaaaaacaaaagtaaacaagtttggcattcaattctcaaccttctctctttctacactcttcacaaatccttcctttagactcttctccctgctatactgacatcgtcttgctttttcttaagccactattcctgaccagaatgcctcttggttattctttccattcaaatttataaatattcccacggctttaaaaaaaaaaaaaagtcagtcgtgcaccaacgttaaatttttgactgagttttaagaagagaagttttccaagttaagccccactacatcagttacattttgaatttatttattttccatgtattatgtctggacagttggcatacttggaaactctttagtcatgtatgtatcattttataacttttaaaggaattcttgtatgggacaactactgggaagtgaatgctatgctttgaaagcaaggagacagcgttaaaaacatcaatacagaccaaagggcatccagtgggaactgaactctgagtgagcggcgacagctcccggtatcgtgggattcttaagtaaaccttgtccccaggccaggtccggacatccttccgggactgcttcaggcaaactcctaaggtcgctgtagcctgcaggccacaccctaaggcactttaagggcctacacctgtg

SEQ ID NO: 1639 - DNA, 700 bp, Homo sapiens
acatcaatacagaccaaagggcatccagtgggaactgaactctgagtgagcggcgacagctcccggtatcgtgggattcttaagtaaaccttgtccccaggccaggtccggacatccttccgggactgcttcaggcaaactcctaaggtcgctgtagcctgcaggccacaccctaaggcactttaagggcctacacctgtggagccctagggacgcttctgctcctaaggagagttctcaacttcccattttattctccgaaagatgtagcgacctgtaaactgaaggcggctactgaagacttaccgtctttcccgccccattgggtccaaccaaaattgtaagggggctgaagaaagtgataatttgcttatctttgtcctctattccaaaactccgcacgcccagaatgctcatcttttcgatccgggacatgtttgcaaacgtttctaatctcaccagggacctggagtccacaaaggcttaactgaggccgaagcaaggcgtgcacgggacgtgagacccgcgaatctcagggtcaggaggatccgggcggggagcgaggccacaggactgccaaaagatcctgccagccaacagcgggagagagggggcgggggatggagcctttcctcccacaccagctgctttccccgccggtggggagagcggaggcggggaccagcctggggctgcccgc

SEQ ID NO: 1640 - DNA, 700 bp, Homo sapiens
  misc_feature (1)...(700): n = A,T,C or G
caaggcgtgcacgggacgtgagacccgcgaatctcagggtcaggaggatccgggcggggagcgaggccacaggactgccaaaagatcctgccagccaacagcgggagagagggggcgggggatggagcctttcctcccacaccagctgctttccccgccggtggggagagcggaggcggggaccagcctggggctgcccgccggggacgcaaagccgtagccacaatgcgaccccgcaaccgcgcactcacangcttcctgcctcggccgccctgcggatcacgtgggcctctaggcccgcacgcgtccacgccgctctcctggggcacgccgggaaatcagagtcccgcggtgcgtgcgcagctccgacttccgggtgcggtacggcgaagcagagggctaggtgctgggtgctgttgccaggggcagcggacttccggatctttgctggggatgggcagcctggagaggcactgacttttggaaggggagaccaagacctgtgacggatggcgcttcccaaagcttgatcctgggactcctggaatgggggtagtggtggggtggattggagacccaggaagcggggtcagttcatgtcaaaactattttccttttcattctcattctctctctaacgttcgtgtagtaatttccagtgatcacataacatgtgatgacgccattgcagtggcggtta

SEQ ID NO: 1641 - DNA, 700 bp, Homo sapiens
cctgtgacggatggcgcttcccaaagcttgatcctgggactcctggaatgggggtagtggtggggtggattggagacccaggaagcggggtcagttcatgtcaaaactattttccttttcattctcattctctctctaacgttcgtgtagtaatttccagtgatcacataacatgtgatgacgccattgcagtggcggttaatggaatgtgcgcatgtgtattcttgcgcttagaaataccaattttaatttctaattgagtaaatgttgataattataactcacgtacacgctctttgaggtcccccgtaattttttagtgtaaaggcgtctttaagaccaaaagtctgggaactaaaactaaaagcagtctgcaaatatgaagaatgtagaggtaatccattccgatcagtgctcccagcaatagatatctttaaaaataagggaaagagaagttacctgtctcagaagtaactgagaatattgctttcttggaaacaaacttaatggagggatatcacatttaagggcctagagaaacatacataaaaattactgaaacaatagtggaggacatttaaatgaaacacaaatttggaattactgtagtggtataatttgcctctgcctgccttggaaaaatgtaggaaatgtttctccagtcatacaatcccaagcaaataatttacagaacctaata

SEQ ID NO: 1642 - DNA, 700 bp, Homo sapiens
aaacttaatggagggatatcacatttaagggcctagagaaacatacataaaaattactgaaacaatagtggaggacatttaaatgaaacacaaatttggaattactgtagtggtataatttgcctctgcctgccttggaaaaatgtaggaaatgtttctccagtcatacaatcccaagcaaataatttacagaacctaatacataaatgtatgtgccaaaggatgcaagtggggaagaccagtgagaaatagtctcttgctgtaccaggttaaaaaaaccggaaagtgtcagttattacaaaatagttaaaataactaatggaacaaaacattaaaattatataggaatgtcttacttggcaaagcaaatgtaataaaacaatgggaaaagacgaaagacctttttttattttaaaaattgtaaaatacacataaaatttactgtcttggccaggcgcggtggctcacgcctgtaatcccagcactttgggaggccgagacgggtggatcacgaggtcaggaaatcaagaccatcctggctaacacggtgaaaccccgtctctactgaaaacacaaaaaattagccgggcatggtggcaggcgccgatggtcccagctactcaggaggctgaggcaggagtatggcatgaacccgggaggcggagcttgcagtgagccgagaccgcaccactgcactcca

SEQ ID NO: 1643 - DNA, 700 bp, Homo sapiens
acgggtggatcacgaggtcaggaaatcaagaccatcctggctaacacggtgaaaccccgtctctactgaaaacacaaaaaattagccgggcatggtggcaggcgccgatggtcccagctactcaggaggctgaggcaggagtatggcatgaacccgggaggcggagcttgcagtgagccgagaccgcaccactgcactccagcctgggcaacagagcgagactccgtctcaaaaagaatttactatcttaaccaagtgtacatttcagtggtgttaagtatactcacgtacaaccgtcaccacctttcaacctctacaaatcttttcactttgcaaaacaaactacccattaaacaataaccctttcctccccacatcctccaaaccctgacaaccaacattctacttactgtctctataattttttactaagtacctcatataagtggaatcatacagtatttatctttttgtgactggctcatttcacttataatgtcctcaaggttcatccatgttgcagctcagtccccaacccctgggtcactgaccagtatgcatacctggcctgttaggaacctggtggcacagtaggaggtgagcagcaggtgagtgaacattaccacccgagctgggcctcagatcagtgggggcattagattctcataggagcacaaaccgtattttgaactgcccatga

SEQ ID NO: 1644 - DNA, 700 bp, Homo sapiens
cctcaaggttcatccatgttgcagctcagtccccaacccctgggtcactgaccagtatgcatacctggcctgttaggaacctggtggcacagtaggaggtgagcagcaggtgagtgaacattaccacccgagctgggcctcagatcagtgggggcattagattctcataggagcacaaaccgtattttgaactgcccatgagaaagatgtaggttgccccatgcaagggatctagcttgcccattccttatgagaatctaatgcctgatgatgtgaggtcgaacagtttcatcccaaaaccatcaccccactcctgtctgtggaaaaactgtcttccgtgagactggtccctggtgccaaaaaggttggggaccactgtagcatatatcagaattcaggtcgtttttaaggttgaataagattcattacaatacacatcacattttgcttatccatctattgatggacatttgggttactttcacattttagctattgtgaatagtgtggctatatatattggtgtacaaatgtcacttctggaccctgctttcaattcttttgggtatatacccagaagtggaattattagatcatacagtaattcaatttttaattatttgaggaactgccatactgttttccacagtggttgtaccatttgacattcccaccaatagtgcataagggtttcaatttc

SEQ ID NO: 1645 - DNA, 700 bp, Homo sapiens
gaatagtgtggctatatatattggtgtacaaatgtcacttctggaccctgctttcaattcttttgggtatatacccagaagtggaattattagatcatacagtaattcaatttttaattatttgaggaactgccatactgttttccacagtggttgtaccatttgacattcccaccaatagtgcataagggtttcaatttctacatatgcttgccaacacttgttattttatgtttttttatggtagccatcctgatgagtgtgaagtgatacctcattgtaattttgatttgcatttcaataattattagtagcatcatttcatgtgtttattggccatttgtgtatctttgaataattgactattcaagtggagactttttttttttttttttttgagatggagtctcactctgtcacccagactggagtgcaatggtgcgatcttggctcactgcaacctccatctcccgcgttcaagtgattcttctgcctcagcctcctgagtagctgggattacaggcacgtggcaccacacctggctaattttttgtatttttagtagagacggggtttcaccatgttggtcaagctggtctcgaactcctaaccttgtgatccacccgcctcggcctcccaaagtgctgggattacaggtgtgagccactgcgcctggccaagaccattttttaagtcagat

SEQ ID NO: 1646 - DNA, 700 bp, Homo sapiens
ctcctgagtagctgggattacaggcacgtggcaccacacctggctaattttttgtatttttagtagagacggggtttcaccatgttggtcaagctggtctcgaactcctaaccttgtgatccacccgcctcggcctcccaaagtgctgggattacaggtgtgagccactgcgcctggccaagaccattttttaagtcagatttattgaagcataattaacatacagtaaaattcacccttttccagggtacaattccatgtgttttggcaaatataaacatttgtgtaaaccaccaagacctttttttttttttttttttttaagacggagtctctctctgttgcccaggttggagtgcagtggcgcgatctcagctcactggaagctccgcctcccgggttcacgccattctactgcctcagcctctgaggactgtagctgggactacaggcgcccgccaccgcgcccggctaatttttgtatttttagtagagacggggtttcaccgtgttagccaggatggtctctatcccctgacctcgcgatccgcccgcctcgggctcccaaagtgctgggattacaggcgtgagccagcgtgcccggccaccaccaagaccatttaaatgaatactgtggagacttggatatcagtaggaagaaaaaagcaaatctacactttactttacttaccactgtaag

SEQ ID NO: 1647 - DNA, 700 bp, Homo sapiens
ggtttcaccgtgttagccaggatggtctctatcccctgacctcgcgatccgcccgcctcgggctcccaaagtgctgggattacaggcgtgagccagcgtgcccggccaccaccaagaccatttaaatgaatactgtggagacttggatatcagtaggaagaaaaaagcaaatctacactttactttacttaccactgtaagttctggtggataaaatttcagaaagatatttcgggaagcaataaaagaagaagcaagaaatgtaattacctctacttttaaaggggaattttatgacccaaagtagcataagaaattagcaatcactgagataagatattgctcgtctctggtcttagcatgaagtacccaacattatctcttatgcagttttgctttcttaaaaacggaaaaaagttgaacttgaatctaatcatacctttagatgtaactttcagttcacaggaattacaaggattaagctaacagcaacacagggttggaaaaggcaaatccagaagctagaaactgttacaagacactggcacaggctctcaggagatcattatcattaaagcaaagactattgtagattttaaaagacttattaaaaaacattttgttgcaaattaagagatttgagatacataccaccccaatggaatgcatggtcctagtttggaaactggttttgccatag

SEQ ID NO: 1648 - DNA, 700 bp, Homo sapiens
ttggaaaaggcaaatccagaagctagaaactgttacaagacactggcacaggctctcaggagatcattatcattaaagcaaagactattgtagattttaaaagacttattaaaaaacattttgttgcaaattaagagatttgagatacataccaccccaatggaatgcatggtcctagtttggaaactggttttgccatagatgtgtgaaggaaatttgggagataagtagggaaatttcaatgtagactggaaattagataataaaaaaattctctgaggcaggcggatcatgaggccaggagattgagaccatcctggctaacacggtgaaaccccgtctctactaaaaatgcaaaaaattagccgggcctggtggcatgcacctgtagtcctagctactcaggaggctgaggcaggaaaatcgctgaacccgggaggtagaggttgcagtgagccaagatcacgccactgcactccagcctgggtgacagagcaggactctatctcaaaaataataataattcttgttaatttcattgtatttggtgtgataatattttgctatgtaagaaaatgatcttttttgagatgcatatggaagtattagtgatagtgtgtcatgttgtctgtaatttaaaatacttcagaaaaaaaatagtgagttgaaggaaaaaaatggacatgccaaggtaaccagg

SEQ ID NO: 1649 - DNA, 700 bp, Homo sapiens
actctatctcaaaaataataataattcttgttaatttcattgtatttggtgtgataatattttgctatgtaagaaaatgatcttttttgagatgcatatggaagtattagtgatagtgtgtcatgttgtctgtaatttaaaatacttcagaaaaaaaatagtgagttgaaggaaaaaaatggacatgccaaggtaaccaggttccattacaaaaaaatttcaactttgtaacaatggaaactataaaactaagataaaagctctaggattggggtggaaaagatttgtaatcaaaatgattaatccctaaaataaaaaggcaaatcagtgaagtctccacttcttagtaaactactacttccaaaaaatatttagtttcactggtgctaaaattaatgaaataaaaaataaaactactatgagatactgttttatacctaatagagaacttctttattctttgttttttgttgttgttgttgttgtttttgtttttgagacagagtctcgctctgttgccaggctggagtgcagtggcgcaatctcggctcactgcaacctctgcctcccgggttcaagcgattctcctgcctcagcctcccgagtagctgggactacaggcgtgcaccaccaagcccagctaatttttgtatttttagtagagacggggtttcactatgttggccaggatggtctcgat

SEQ ID NO: 1650 - DNA, 700 bp, Homo sapiens
acagagtctcgctctgttgccaggctggagtgcagtggcgcaatctcggctcactgcaacctctgcctcccgggttcaagcgattctcctgcctcagcctcccgagtagctgggactacaggcgtgcaccaccaagcccagctaatttttgtatttttagtagagacggggtttcactatgttggccaggatggtctcgatctcttgacctcatgaaccaccctcccaaagtgctgggattacaggcttgagccgctgcgcccagcctgagaacctctttattcttacaatactttctaacataattctcccttttttctgatattaatattggtacatgagctttcttttgactagtatggattcgttcttagaaattgcaatttaagggaagtgaaaccaattttatcataggctagttgatataaacaagagacaagttcgtagaacatatttttggtcataaaaatatcatcaaacttataaataaagatgaaaacacttctattcaatattaaacattgaaacaaatgtgagcaatagatacatttaagaaagattcataaaagcaagtaaaataagtatttgcccaactattccagttcaagtttgcaggtggctggagcttttcccatcagctcagggtgcgaggtgggcaccaaccctgaacaggatgccattccatcacagaacacacaca

SEQ ID NO: 1651 - DNA, 700 bp, Homo sapiens
cacttctattcaatattaaacattgaaacaaatgtgagcaatagatacatttaagaaagattcataaaagcaagtaaaataagtatttgcccaactattccagttcaagtttgcaggtggctggagcttttcccatcagctcagggtgcgaggtgggcaccaaccctgaacaggatgccattccatcacagaacacacacacatgcatgcacacacacacacacacacgcagactgggactatgtagacatgccaattcacctcacatgcacatatttgggatgtgagaggaaactggagtacccagagaaaccccacacagacattaggaaatgtgcaaactccacacagcctggccaagaattaattattgttttctcgtgaatgttataacaaagttattctaggacctgctatgtatctttgcatccaaacttcctatgttgttttgcattgtgtatctcttgaaaatagctgatagatgatttctaatgcaattttatagtatttgccttttaataaatgactttcatctgttttcaattactgtgattgctggtaaatttaggcatatgtcttattcctgtgctttttctttgtttctttgtctcctttcctgctttgtagaatatccaagctttctttattccttgttttactctactgatttggaaaatacacattctatttctattctttt

SEQ ID NO: 1652 - DNA, 700 bp, Homo sapiens
ttatagtatttgccttttaataaatgactttcatctgttttcaattactgtgattgctggtaaatttaggcatatgtcttattcctgtgctttttctttgtttctttgtctcctttcctgctttgtagaatatccaagctttctttattccttgttttactctactgatttggaaaatacacattctatttctattcttttactgggcactcttaaatttttcacattactattttgaagtccagagttaatatcattaggatccttctgaacaatacaaggactgtaaaatgtgccagaagatcaccccccaccttccacattatcactatttagcatttttgttcctcattgtcttcaaataagaaacaaaacaaatgaaatcagttatttttaaaccagcattattcatttaggtttaccagcatatttatcaaactctttgattcccactgcttctgcgtcacttcttccttctgggttcattcgctctccattagcaaaacctttaaagcctggtgctaatggaccttcagagaaagaaatatatctcctggtgctaatatcaagattaaacaaagctatttttgtgaaaatgctttataaattgtaaaaccctgtgaaaatataagagttatttttttctggccaggcgcattggctcacacctgtaatcccagcactttgggaggccgagatg

SEQ ID NO: 1653 - DNA, 700 bp, Homo sapiens
gcaaaacctttaaagcctggtgctaatggaccttcagagaaagaaatatatctcctggtgctaatatcaagattaaacaaagctatttttgtgaaaatgctttataaattgtaaaaccctgtgaaaatataagagttatttttttctggccaggcgcattggctcacacctgtaatcccagcactttgggaggccgagatgggcagatcacgacgtcaacagatcaagaccatcctggccaacttgttgaaaccccgtctctactaaaaatacaaaaattagctgggcatgatggcgcgtgcctttagtcccagcttctctggaggctgaggcaggagaatcgcttgaacccaggaggcggagcttgcagtgagctgagattgtgccactgcactccagcctggcgacagagtgagactctgtctcaaaaaaaaaaaaaaaaagatttcttttttctgcattggatattttcagagggtaatctggtaaaatgtaacaaagctataaacatgattatacaagttcattagcataaggaaaatttttaaaattttacacaggtgtttatagtagcattgtttaaaattgtggaaggctagaaacaaccccagtgcctaaaagttgggaaatggtgatggaaactatggtacatcagtttcatctaatagcaggttatcactaaaataataagtaggaaatt

SEQ ID NO: 1654 - DNA, 700 bp, Homo sapiens
agctataaacatgattatacaagttcattagcataaggaaaatttttaaaattttacacaggtgtttatagtagcattgtttaaaattgtggaaggctagaaacaaccccagtgcctaaaagttgggaaatggtgatggaaactatggtacatcagtttcatctaatagcaggttatcactaaaataataagtaggaaattgtatagatatgtgaaaaagaaatactcataaaaaagataaatacaaactgcatatattcactgattaaaactgtaaaactgtctatgtgttggtaaggtttagaagatgatttcaaaaaactgatagttgctataccaagaaattctgtgtttattttcctataatgttatttattcaattaaaaaatcatattaaagggagattgaaaggatagaatttcgaatagagtcaagaagaaaaagagatgttatcaatttacatttagtcatcatgaaaattgcgaggcatcatgctcagttgattagaatcagttcatggaaaagtcatttgaccttaaggactacacagtaaaaaccacagttatcagttttaaagacatgttgccaatgtgttacccactaatagagataaaagttttagggcaaaaggatggatgttacccgccaatgtaacttttcaatattaatcaaagtgctttttttaaattataaaattacc

SEQ ID NO: 1655 - DNA, 700 bp, Homo sapiens
ttgattagaatcagttcatggaaaagtcatttgaccttaaggactacacagtaaaaaccacagttatcagttttaaagacatgttgccaatgtgttacccactaatagagataaaagttttagggcaaaaggatggatgttacccgccaatgtaacttttcaatattaatcaaagtgctttttttaaattataaaattaccaaccagtaattatttaaaaatcaaagtactaattgtttatttctttctatttccctaaaataacgtggattttaaaaaatctaaatggtagttcacattgcctccgtctctgtagctgaactttaaagctttgctctcttttgcccaggagttctgccaaagaactcctgttgtttgttactttaggctcctagctgcaggtaaaagactccttgaggccgggcacggtggctcatgcctgtaatcccagcactttgggaggccgaggcgggcggatcacgaggtcaggagtttgagaccagcctggccaagatggtgaaaccccatctctactaaaaatacaaaagttagccgggcgtggtggcagttgcctgtaatcccagctactcaggaagctgaggcaggagaatcgcttgaacctgggaggcggaggttgcagtgagccgagattgcaccactgccctctagcctgggtgacagagcaagactctgtctcaaa

SEQ ID NO: 1656 - DNA, 700 bp, Homo sapiens
ccagcctggccaagatggtgaaaccccatctctactaaaaatacaaaagttagccgggcgtggtggcagttgcctgtaatcccagctactcaggaagctgaggcaggagaatcgcttgaacctgggaggcggaggttgcagtgagccgagattgcaccactgccctctagcctgggtgacagagcaagactctgtctcaaaaaaaagaaaaagacttcttgagtttccacagtatagtaatcctcacttaatgtcatcaataggttcttggaaacagactttaagggaaacgatgtataacaaaaccaattttaccgtaggtgaattgatatgaacaaagcttacattcctatggcatatttctggccacaaaaatatcatcacacttctaaacaaagaccaaacacttctaatattaaacattgaaacaattatgagctatatgtacatttaagaaagattcataaaaacaagtaagataacttacccaactattccagttgaaggttgaagatggctggagtttatcccggtagctcaaggtacaaggtgagcaccaatcctggatagggcgtcattccattgcagagcacacagacgcacacacagacgcacacacacacactcacagactgggactgtgtagacatgccaattcacctcgcgtgcacatctttgggatgtgagagattgtgcaaac

SEQ ID NO: 1657 - DNA, 700 bp, Homo sapiens
gttgaaggttgaagatggctggagtttatcccggtagctcaaggtacaaggtgagcaccaatcctggatagggcgtcattccattgcagagcacacagacgcacacacagacgcacacacacacactcacagactgggactgtgtagacatgccaattcacctcgcgtgcacatctttgggatgtgagagattgtgcaaactccacatagacaatggctttggctgggaagcgattgtttttcttatcaacagtataatgaaataacgtggaactaagcaaagttattcaaggacctgctgtattcacattaactcaacgagtacaacaaaagataaagttgttgtaagtgcctgcttgttcattcagttagttatttaacaaatctttattttactgtctacaataggctagtcctcaaggatgaagagatcgattcaataaaaaccttattctcaaggagctcatagtctactggtgaaataaaaaggtgccaactgcattacactcatggaattcaaagttctgctttttttttttttttgagacagggtctcactatgttgcccaggctagtcttaaactcttgggcccgattgatcctctggcctcagcctcctgagcaaagccttttaaataataatggtaaaaacaatcattaactttttcaatgtgcagtattattatttatttatttaatt

SEQ ID NO: 1658 - DNA, 700 bp, Homo sapiens
cattacactcatggaattcaaagttctgctttttttttttttttgagacagggtctcactatgttgcccaggctagtcttaaactcttgggcccgattgatcctctggcctcagcctcctgagcaaagccttttaaataataatggtaaaaacaatcattaactttttcaatgtgcagtattattatttatttatttaattatttgaaatggaatctcgctctgtcacccaggctagagtgcagtggcgctatctcagctcacggcaacctctgcctcctgggttcaagtaattctcctgcctcagcctcccaagtagctgggattacaggcgccagccaccaagcctagctaatttttgtattttagtagaaacagggtttcaccatattggccaggctggtctcgaactgctgacttcaaccaatccacccacctcagcctcccaaagtgctggggttacagacctgacccatcatgcctcgccgcagtattatttttaatacactttttattttaagtagttttagatttatagagaagtttcaagactgttagagagcattccagtgtgccctgcacccagtttcccattgttaacattactatggtacaattgtcacaactaaggaactaatattggtacattactaaactccaggctttttccaattcccttagttgtgcccgttgtccttatt

SEQ ID NO: 1659 - DNA, 700 bp, Homo sapiens
taatacactttttattttaagtagttttagatttatagagaagtttcaagactgttagagagcattccagtgtgccctgcacccagtttcccattgttaacattactatggtacaattgtcacaactaaggaactaatattggtacattactaaactccaggctttttccaattcccttagttgtgcccgttgtccttattctgttcctgagtgtcatccatgataccacattgtatgtagtcatcacgtctcttagaggcctctctggctgtgtcagtttctcagactgtgcttgtttttgatgaccttaacagttttaaggagtactggtcaggcattttgtctttccatttgggtatgtgtagtgtttgtgtcatggttaggcagaggttactggttttggggaggaagatgacagggataaagttcctttcttatcacatcaaatcaaaggtacatgctgttaacatgatgtttcactgccaccattgactgggatcacctagctgaagtagtgtttgatcaggtttctccactgtgaagttattcctcttattctcccctttccatacagttctcttttttaaaaagtcactctgtatatcccactcttaatgaaagggggttgtgttccatctccttgagggtgtagtagctacatacattattttgaattcttgggcacaggagattaaaatc

SEQ ID NO: 1660 - DNA, 700 bp, Homo sapiens
tcacctagctgaagtagtgtttgatcaggtttctccactgtgaagttattcctcttattctcccctttccatacagttctcttttttaaaaagtcactctgtatatcccactcttaatgaaagggggttgtgttccatctccttgagggtgtagtagctacatacattattttgaattcttgggcacaggagattaaaatcattaacttttatttggagttttgcattaataaagctctttcttttttttgagatggagtctcgctctgttgcccaggctggcgtgcagtggcgtgatctcagctcactgcaacatccacctcccaggttcacgccattctcctgcctcagcctcctgagtagctgggactacaggtgccggccaccatgcccagctaatttttttgtatttttagtggagatggggtttcactgtgttagccaggatggtctcgatctcctgacctcgtgatctgcccgcctcagcctcccaaagtgctgagattacaggtgtgagccaccatgcctggccaataaagctctttcaaatacattattttacaggtccaactccgagacagtttacagtcaggttggggagatcacacttatagaggaaaagttaatgacacgaaaactttataagaaatttaattttgtacacccatgttcatagcagcattattcacaatagccaaag

SEQ ID NO: 1661 - DNA, 700 bp, Homo sapiens
tgagattacaggtgtgagccaccatgcctggccaataaagctctttcaaatacattattttacaggtccaactccgagacagtttacagtcaggttggggagatcacacttatagaggaaaagttaatgacacgaaaactttataagaaatttaattttgtacacccatgttcatagcagcattattcacaatagccaaaggatggaagcaacattggtgtccatcgacagaccatggataaacaaaacatggtatagacatccaatgaaatattattcagccttaaaaaggaagaaaattgacacatgctacaacatggatgaatcttgagaatagacattatgctaaatgatataagccagtcacaaaaagccaagtactgtatatcaggtacctaaagtcatcaaattcataaagacagaaagtagaagcgtggttgcaaggtgctgggagaacgggggcgggggttgggagctgttgtttaatgggtacagagtttcagttttgcaagatgaaaagagtcctggagatttgtcacacaacattatgaatgtacttaaggctactgagctgtacacttaaaaaaatggttaagatagtaaattttatgtgtattttgccacaattaaacatttctaaaagaaatacaattttgaataagaagtattttttataactagccttccaataagaacccac

SEQ ID NO: 1662 - DNA, 700 bp, Homo sapiens
tcagttttgcaagatgaaaagagtcctggagatttgtcacacaacattatgaatgtacttaaggctactgagctgtacacttaaaaaaatggttaagatagtaaattttatgtgtattttgccacaattaaacatttctaaaagaaatacaattttgaataagaagtattttttataactagccttccaataagaacccacagttttgctgtaaaacagaggctgcaaaatggtacattatacagttgccaacatttgaaaaatccagagattatatataataagcaggatttcagccttccttttttgttgttgttgttgttgttgtgctttttgtttttttgtttgtttgtttgttttgagacagtctcactctcttgcgcaggctggagtgcagtggtgcaacctcagctcactgcaacctccgcctcctgagttcaagcaattctcctgcctcagcctcccgagtaactgggattacaggcacacaccaccacgcctggctaatttttataaaggcttctttgaaaaacagaatgatcgggtaatgtgagcccaggtgtgtcacctggcaaccatcagctggagctgagcagcacctgccacctttagacagatcatgcatgctatagtttcatgtgacccccaccagctttgatgtattacaccctgcccatttcactcactggtcttgaactcc

SEQ ID NO: 1663 - DNA, 700 bp, Homo sapiens
ctggctaatttttataaaggcttctttgaaaaacagaatgatcgggtaatgtgagcccaggtgtgtcacctggcaaccatcagctggagctgagcagcacctgccacctttagacagatcatgcatgctatagtttcatgtgacccccaccagctttgatgtattacaccctgcccatttcactcactggtcttgaactcctgggctcaagggatccactgcctgggcttaccaaagtgctgggattacaggcgtgagccactgtgtttagcccaattttttattttttctagagatggagtctcactatgttgcctgggctggtctcaaactcctgggctcaagcaatccttctgcttcagcctcccaaagtgctgggattacaagcatgagccaccttgcccagcctcctatgatagaatttaagcactcagaactttgtgtatttaaggtactaaaataacaagttatttggcaattcccctgaaactttcacctaagccctaacttcctcagtgtaacataaaggtgtcagggggaatcagagagaacgctctcatattctctgggaagagaaagctcctgccagaactcagcttcttttctgagaataccattttaagagcactttgaccaagcctattgtgattcctactcccgaaaatctcactcccgatagattttctgaagtgagccaaac

SEQ ID NO: 1664 - DNA, 700 bp, Homo sapiens
agccctaacttcctcagtgtaacataaaggtgtcagggggaatcagagagaacgctctcatattctctgggaagagaaagctcctgccagaactcagcttcttttctgagaataccattttaagagcactttgaccaagcctattgtgattcctactcccgaaaatctcactcccgatagattttctgaagtgagccaaacttctgcagtctcaaggaaacatttctcaaggaaaacatttctcaagtgcgcaaatcagacacatctaaccaagagtccaaaacttcagcacaaacaaaaccaaacgtggtacaagaaggccgccactgaaatccaagactgtctttatctttccagtgcagagctgggattgagtatgtatgaaaggtgtgtctacctcccagctgcctctacttctcctacacaactgcacctagctttggaaaactgttctgggcaacagtttgtgtttggtaccatctgttcttgacgctcaagacaggcctgaagtcaggcttctaggctgcaacatagagccactctgggatgctcactgaagcactctattaaaaacaatgagccacatacacctccatcatatgtgttcaggccagggaaaaaggaagtgtgtgatctaggagggggcctcatttgtacctttctgggattacaggtctgagcctaaggaacaaaggctgat

SEQ ID NO: 1665 - DNA, 700 bp, Homo sapiens
  misc_feature (1)...(700): n = A,T,C or G
caggcctgaagtcaggcttctaggctgcaacatagagccactctgggatgctcactgaagcactctattaaaaacaatgagccacatacacctccatcatatgtgttcaggccagggaaaaaggaagtgtgtgatctaggagggggcctcatttgtacctttctgggattacaggtctgagcctaaggaacaaaggctgattcccctaatttcatggcccgcccaaggtgtgaaaggacacctccacccttatgggacataaaggagaggacacatccatgtattatgtatctgtgacagatatttattggttgccttcctagaatctgtgtcccccttactactgggaccccacatttctaagctatgcagttgaggtaggattagggtcacctctagctccagggagagccaatcagtatatactacaccctggtcacagttcaaggatgaacatgtgacccttgtcagaaagagactgaatttgaaagcttttgattaaacaatcagaaaagcacagcttgctttttcctgctgctcatgaacagaatacatanagatccaggagtctggacatcatcttgagacctcaatgggaaaggtgcccaaggatggagtcaaggaagagtcactgaagccatcaaaatgtaaaagagcctccattcctggactgtttggttctatgagccaataccttccc

SEQ ID NO: 1666 - DNA, 700 bp, Homo sapiens
  misc_feature (1)...(700): n = A,T,C or G
taaacaatcagaaaagcacagcttgctttttcctgctgctcatgaacagaatacatanagatccaggagtctggacatcatcttgagacctcaatgggaaaggtgcccaaggatggagtcaaggaagagtcactgaagccatcaaaatgtaaaagagcctccattcctggactgtttggttctatgagccaataccttccctctttatcttcaacaactttaggttaggtttttagtcactggcaacagaaaggatcctaatcaagaccccagtgaacagaactcgaccctgccaaggcttggcagtttccatttcaatcactgtcttcccaccagtattttcaatttcttttaagacagattaatctagccacagtcatagtagaacatagccgatctgaaaaaaacattcccaatatttatgtattttagcataaaattctgtttagtggtctaccttatactttgttttgcacacatcttttaagaggaagttaattttctgattttaagaaatgcaaatgtggggcaatgatgtattaacccaaagattcttcgtaatagaaaatgtttttaaaggggggaaacagggatttttattattaaaagataaaagtaaatttattttttaagatataaggcattggaaacatttagtttcacgatatgccattattaggcattctctatctgattgtta

SEQ ID NO: 1667 - DNA, 700 bp, Homo sapiens
tttctgattttaagaaatgcaaatgtggggcaatgatgtattaacccaaagattcttcgtaatagaaaatgtttttaaaggggggaaacagggatttttattattaaaagataaaagtaaatttattttttaagatataaggcattggaaacatttagtttcacgatatgccattattaggcattctctatctgattgttagaaattattcatttcctcaaagacagacaataaattgactggggacgcagtcttgtactatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgaggtaattttctttatgattcctacagtctgtaaagtgcataggtaatcatttgtgatggttcctttactatatatagagatctgttataaataataagattctgagcacattagtacatgggtgataactacatcaccagcaaacattctgttaaaagttatgaatgctggtgtgctgtaaaaatgattgtatttcctttcctctccagactctgaggattcctgttcctgtacataaaaatgtaagttaaat

SEQ ID NO: 1668 - DNA, 700 bp, Homo sapiens
gtgatggttcctttactatatatagagatctgttataaataataagattctgagcacattagtacatgggtgataactacatcaccagcaaacattctgttaaaagttatgaatgctggtgtgctgtaaaaatgattgtatttcctttcctctccagactctgaggattcctgttcctgtacataaaaatgtaagttaaattatgattcagtaaaatgatggcatgaataagtaaatttcctgttttaagctgtaaatcattagttatcattggaactatttaattttctatattttgttttcatatgggtggctgtgaatgtctgtacttataaatatgaggaatgactttttatcaagtagaatcctttaaacaagtggattaggctctttggtgatgttgttagtttgcctcccaaagagcatcgtgtcagggattctttccagaaggattccacactgagtgagaggtgcgtgctagtctccgtgcagttctgactctttctcactctaacgtgtttctgaaagtattagcaactcagaattatatttttagaaccatgatcagtagacattaaaatatataacaaatgccctatattaataatttctgcatacttaaataattatgactatatgatggtgttgtatgcatttgaatatgtcctggtcatattaaaatgtaaaatatatagtttta

SEQ ID NO: 1669 - DNA, 700 bp, Homo sapiens
tctttctcactctaacgtgtttctgaaagtattagcaactcagaattatatttttagaaccatgatcagtagacattaaaatatataacaaatgccctatattaataatttctgcatacttaaataattatgactatatgatggtgttgtatgcatttgaatatgtcctggtcatattaaaatgtaaaatatatagttttattagtctaaatagaataaaactaccagctagaactgtagaaacacattgatatgagtttaatgtataatgcattacacttccaaaacatttttttccagttacataattaagttatatcctttataaaactcctcagtaatcatataagcttcatctactttttgaaaattttatcttaatatgtggtggtttgttgcctagaaaacaaacaaaaaactctttggagaagggaactcatgtaaataccacaaaacaaagcctaactttgtggaccaaaattgttttaataattattttttaattgatgaattaaaaagtatatatatttattgtgtacaatatgatgttttgaagtatgtatacattgcagaatggacaatggaccaaatttttataccttgtcttgattatttgcattttaaaaattttcctcatttagcaccaactgtgcactgaagaaatctttcagggaataggcacactggagagtcaaactgt

SEQ ID NO: 1670 - DNA, 700 bp, Homo sapiens
  misc_feature (1)...(700): n = A,T,C or G
ttaattgatgaattaaaaagtatatatatttattgtgtacaatatgatgttttgaagtatgtatacattgcagaatggacaatggaccaaatttttataccttgtcttgattatttgcattttaaaaattttcctcatttagcaccaactgtgcactgaagaaatctttcagggaataggcacactggagagtcaaactgtgcaagggggtactgtggaaagactattnaaaaacttgtccttaataaagaaatacattgacggccaaaaagtaagttacacacattcaatggaagctatatttgtctggctgtgcctatttctatggaattgacagtttcctgtaatacctattgtcatttttcttttttcacagaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcantataatttaacttcagagggaaagtaaatatttcaggcatactgacactttgccagaaagcataaaattcttaaaatatatttcagatatcagaatcattgaagtattttcctccaggcaaaattga

SEQ ID NO: 1671 - DNA, 700 bp, Homo sapiens
  misc_feature (1)...(700): n = A,T,C or G
aagattttggaggagaaggacattttactgcagtgagaatgagggccaagaaagagtcaggccttaattttcantataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttcaatttgctgctggcctctgtcttagcaattgaagttagcacagtccattgagtacatgcccagtttggaggaagggtctgagcacatgtggctgagcatccccatttctctggagaagtctcaaggttgcaaggcacaccagaggtggaagtgatctagcaggacttagtggggatgtggggagcagggacacaggcaggaggtgaacctggttttctctctacagtatatccagaacctgggatggtgcagggtaaatggtagggaataaatgaatgaatgtgctttccaagactgattgtagaactaaaatgagttgtaaggcgtcccctggaagaagggcagtgtgggaacctg

SEQ ID NO: 1672 - DNA, 700 bp, Homo sapiens
tagcaggacttagtggggatgtggggagcagggacacaggcaggaggtgaacctggttttctctctacagtatatccagaacctgggatggtgcagggtaaatggtagggaataaatgaatgaatgtgctttccaagactgattgtagaactaaaatgagttgtaaggcgtcccctggaagaagggcagtgtgggaacctgtaactaggttcctgcccagcctgtgagaagaatttggcagatcaatctcattgccagtatagagaggaagccagaaaccctctctgccaaggcctgcaggggttcttaccccacctgaccctgcaccataacaaaaggaacagagagacactggtagggcagtcccattagaaagactgagttccgtattcccgggggcagggcagcaccaggccgcacaacactccattctgcctgcttatggctatcagtagcatcactagagattcttctgtttgagaaaacttctcaaggatccagaaaatatgctctttaaaatattttaaaactgatatagacccaaaggagagacccagtaacaatattcagctatattatccattctctctttctttcattcaacaaatctgtattgatcacaggctctctgctgggtgtgggatgcagctgtgggcctgtgctggaggtccttagaggccagtactcctatcctgggctt

SEQ ID NO: 1673 - DNA, 700 bp, Homo sapiens
agaaaatatgctctttaaaatattttaaaactgatatagacccaaaggagagacccagtaacaatattcagctatattatccattctctctttctttcattcaacaaatctgtattgatcacaggctctctgctgggtgtgggatgcagctgtgggcctgtgctggaggtccttagaggccagtactcctatcctgggctttatctgcatggattgctgcagtgttgggctccactgctgtgtgaagcaattgctcctgctctttctgggcatgggagaagggtcagagcagtcggacacagattcccaggcaggagaatggaactccttccgaggaagaagacgtgttttccttccagcacacacccaggcatggtggtcaggaccgtggaccaggtccccaacttgtgcatgcaccaagccccaggatcaggagcagagctagtgagggagcaagatggatgaggacagcacggtgctgaccactctagacagacaggagacaggaaacaggaaactcaacttgcaaaaagactgaatctcaacttgattcaattaggcagatactgagttccagtatactccaggactattctaggggctaggattcaacagtgaataaaacagacaaaatcctttcccttgtacacttatatcctctcaaaaaagctcctttcccctctttcttatcagggtctaa

SEQ ID NO: 1674 - DNA, 700 bp, Homo sapiens
gagacaggaaacaggaaactcaacttgcaaaaagactgaatctcaacttgattcaattaggcagatactgagttccagtatactccaggactattctaggggctaggattcaacagtgaataaaacagacaaaatcctttcccttgtacacttatatcctctcaaaaaagctcctttcccctctttcttatcagggtctaatatagttaataaggacttaagactggaatatcacatctaaatccccaataatgagccctcaccaatctgccaggtcccagagaagctaaaaacaatcagggctgtttgcaactaactgaaataaaacttgattcgaactcatgtcaagcctgttgacaacacacacacatgtccacgtgtcactgctgtgcatagaaacctctgactcactaccatctgaagtccaggctccttcacaggtcattcaaggtcgacctctgccccctctgacccctgacatacagaaatacaggcatcatccatgtaacaaccttggcaagaaaacattaaccaggtgcctcattcccattattttaagtgcgaaaaattttaatgcattatgtctcaacccaaaatcttcaaccaacttcttaaaacataaaacatagtaaaatgcctgtatataaggaaaaaacacattagggtgtaaaaatttaaacaaaatattttgtatttattt

SEQ ID NO: 1675 - DNA, 700 bp, Homo sapiens
tccatgtaacaaccttggcaagaaaacattaaccaggtgcctcattcccattattttaagtgcgaaaaattttaatgcattatgtctcaacccaaaatcttcaaccaacttcttaaaacataaaacatagtaaaatgcctgtatataaggaaaaaacacattagggtgtaaaaatttaaacaaaatattttgtatttatttatttaattgtagtaaaataaggatataagatatttaaaacagtacttcctgatcactcagcagttaatataatggttgctttgtctgtataacatgctgcacgtccccttagttaacattcagagcctttccgattgtcttctgtgaacgctgatttgctactaatcatatgtggaataaacctaaagactttgtccattgactcccctcatcacttggttaaagaatttcttatgtttaggggacataaatatttttacaatataaatattggtgggaaagcattgtattgagagacacgttctatgaagaagaactgtatgtggaaaacatttattgtggagatgttcaggccaggcatggtggcttatgcctgtaatcccagcactttgggaagctgaagcaggaggatcacttgagtccaggagttcaagactagcctgggcaacatagcaagatgtctctacaaaaagaaagaaaagtagccaggcgtggtggt

SEQ ID NO: 1676 - DNA, 700 bp, Homo sapiens
acgttctatgaagaagaactgtatgtggaaaacatttattgtggagatgttcaggccaggcatggtggcttatgcctgtaatcccagcactttgggaagctgaagcaggaggatcacttgagtccaggagttcaagactagcctgggcaacatagcaagatgtctctacaaaaagaaagaaaagtagccaggcgtggtggtgcacatctgtagttccaactactcaggtggctgaggtgggaggatcacctgagcccaggaggtgaggctgcaatgagctctgattgtgccactttgggcaacagtatgaggctgtttaaaaaaaaaaaaaaaaacaaaaaaacaaagagatgatctgtaaagaatgctagctcttattcttcacagaatatccatgaattttcatacctctgtgccttggtccacactataccctctgtctcagtatcttttttctttcccacccaacaaacttgtaattgccctttagatgttttcattcaccatatcctccttctttttttttttttagagacagggtcttgctctgtcacccaggctggaatgcagtggcgtgatcattgctcactgcagccctgaactcctgggctcaagtgattcccctgtttcagcctccccagtagctggggctacaggcacttactaccatgcctagttaatatcttttaaaattattttg

SEQ ID NO: 1677 - DNA, 700 bp, Homo sapiens
ttcaccatatcctccttctttttttttttttagagacagggtcttgctctgtcacccaggctggaatgcagtggcgtgatcattgctcactgcagccctgaactcctgggctcaagtgattcccctgtttcagcctccccagtagctggggctacaggcacttactaccatgcctagttaatatcttttaaaattattttgtagggatggggtttcactatgtgacctgggttggtcttaaacttctggcctcaagtgatcctctcactctggcctctcaaagtgctgggattacaagtatgagccaccacactgccctctttttatttttatttatttatttatttattcatttattatttttttcgagatggagtctcactttgtcacccagcctggagtgcagtggcatgatctcggctcactataacctccacctcctgggttccagtgattctcctgcctcagcctcccgagtaactgggactacaggtgcatgccaccacacccagctaatttttatatttttagtagagacagtgttttaccatgttggtcaggctggtcttgagctcttcacctcaagcaatccacctgcctcagccttccaaagtgctgagattataggtgtgagccaccgtgcccggtctttttatttatttattcattcatttatttatttattttttgagacagagtg

SEQ ID NO: 1678 - DNA, 700 bp, Homo sapiens
ccaccacacccagctaatttttatatttttagtagagacagtgttttaccatgttggtcaggctggtcttgagctcttcacctcaagcaatccacctgcctcagccttccaaagtgctgagattataggtgtgagccaccgtgcccggtctttttatttatttattcattcatttatttatttattttttgagacagagtgtcactctgtcacccatgctggagtgcagtggcatggtctcagctcactgcaagctccgcctcccaggttcatgccattctcctgcttcagcctccctagcagctgggactacaggtgcccaccaccacacctggctaatttttttgtatttttagtagagatggggtttcaccatgttagccaggatggtctcgagctcctgacctcatgatctgcccatctcagcctcccaaagtgctgggattacaggcatgagccaccgtgcctggactgtttttatttttttaagagatagagtcttgctatgttgtccaggctggacgcaaactcttgggttcaagtgatcctcccatctcaccctcctgagtaattggaactataggcaagtgccaccatgtccagcagtttttttaatctcaatgtacctgcctgtggccagctgacctactgctttcatggtctcatatcattgtgtacatttaccatcaggatcacgaca

SEQ ID NO: 1679 - DNA, 700 bp, Homo sapiens
cttgctatgttgtccaggctggacgcaaactcttgggttcaagtgatcctcccatctcaccctcctgagtaattggaactataggcaagtgccaccatgtccagcagtttttttaatctcaatgtacctgcctgtggccagctgacctactgctttcatggtctcatatcattgtgtacatttaccatcaggatcacgacatagagagagtaaaatgcacaggcctataaatgtaacgagctgttacaaaagtttcaaagccacaggaaggttctaccaggtgcttagaatgtttattccatttatacaaaaaagaactagaaaaacagttccagagtataaaagactcaagcctaggagtctccatgtttcacttgtccgatggaagtcccattcttaccaaagaatcatggcagatttaggttttcctggtgtcagtattagctcagacctcatatttaacaatgtttgaaaagtttgggtatctcctatactagtgtgtacttatcctgatgaatggctccagatcgctttggtaaaggattaaagaaagtttactgcatgtatatgtagtgggattatagagtcctcctgttcaatcaatggacactgggtttatgaatgccttagatgtgggaactggaggaagagcttgcatttccactgtggtggctgatgtcagccctttaccacttgatta

SEQ ID NO: 1680 - DNA, 700 bp, Homo sapiens
tgtacttatcctgatgaatggctccagatcgctttggtaaaggattaaagaaagtttactgcatgtatatgtagtgggattatagagtcctcctgttcaatcaatggacactgggtttatgaatgccttagatgtgggaactggaggaagagcttgcatttccactgtggtggctgatgtcagccctttaccacttgattacatatacatgctaattgattatcaacgtttcttgtctctaggaacactttaatttcttagccaccacaatagatccctgaaggttaagagtcaaggcaccctggttggcaccatggccttgctgtttgtggtggtaattatgtcccccttgcctctaatgtttaagtgcttccaacctgagctctgccattctagggatctcatgttgcctattgatattagggagtccatgtcattggcagcatctttcaccttcaacccagcttacaggggacatccaccaccaatgtttgcaatgatgcctgcttctcttcactagtgtatctgttgctgtgttagtaaaaggagtatattctgtgtcctccaggaacatactcagatagtaggttctcaggccagatacaaaaaatccattttagtattcctgcttctctgagctatctgctcttttcttcaatactatgggaggaagttcaggtgtctccacttcatattctgt

SEQ ID NO: 1681 - DNA, 700 bp, Homo sapiens
atgcctgcttctcttcactagtgtatctgttgctgtgttagtaaaaggagtatattctgtgtcctccaggaacatactcagatagtaggttctcaggccagatacaaaaaatccattttagtattcctgcttctctgagctatctgctcttttcttcaatactatgggaggaagttcaggtgtctccacttcatattctgtacaccatcatcaggatcaggcttcaaggagccactccagcaaactattaggactaactccagttgttcttgcgaaaacttaattctgagtcgtaagtatacccacaccaataaatccaatcccattcaactctatattcttctggacaaacagctgcaggatgcactcgattctggattctgacagtacatattagtaaactcctgcacaccttacacttccctgccaagactgtatgtcagctgtgaagctattgtctctcagcttcaagcccactatactatactctgctgcagctgggattctgcaaaccaatttctcctttgccagctgcaaccctgttaggatctgtcaatggagggtgtagactaggaggctggaggaagaaaaggggacttttttcttcctgttgcttcctattctttgtttttgtttcctgttcctgtcctcttatattcctattcctaatcctaatcctaacatgaaccctggcagcagt

SEQ ID NO: 1682 - DNA, 700 bp, Homo sapiens
gggattctgcaaaccaatttctcctttgccagctgcaaccctgttaggatctgtcaatggagggtgtagactaggaggctggaggaagaaaaggggacttttttcttcctgttgcttcctattctttgtttttgtttcctgttcctgtcctcttatattcctattcctaatcctaatcctaacatgaaccctggcagcagtagttgactctagtagcaacatttgattatagtttgcagtttttccaccattcatagaaccgaccttagcacacctcatttccctctgagaccccagcaacagccaatcagcatcccctcagaggtctggatcccattcccaaaggaccccttttctgagctcaggaactgcactgcatgcagagcagtgtcccctctacagatgtctgagtttcaggtccacaaagcccgtcctccaaatttataagttttaataattttcacctgttccctttgcttcccagacatagaagtgctagctgcttcccacaattgccacctccttgataccttattgttccctttttgcctgcctagttttccaatacctggctaacagttctttatatttaattctgcttattaaaataactggtatagtttgtgtctcctggttggtgcctagttaacacaagatgttcttagatctgactttaattattggccttgaggcaataagg

SEQ ID NO: 1683 - DNA, 700 bp, Homo sapiens
ctgcttcccacaattgccacctccttgataccttattgttccctttttgcctgcctagttttccaatacctggctaacagttctttatatttaattctgcttattaaaataactggtatagtttgtgtctcctggttggtgcctagttaacacaagatgttcttagatctgactttaattattggccttgaggcaataaggggtgttgagggagggttgtgggcagaacaaatgtcatcttgtgaagtatatgtttcaagtgaaatagttattctgtttccaggcaaggagaagttagtctactctggcaagggggaaaggtctgcttctaccagttaaggagggctcagagaatttggaggttcaagagttttaggtttgtccacccaaatgtttctatcccaggtctcatggtcccagcctttcctcataagagccctgactttgacacagaatgtgcaaaatccactcttctcctttgaagctcttcaaaggctgcaaataatcagatcctgagcctaattttcagatcggtttgccctgcagttgctggaaataagagtctcctctaaagttgccatgggagttgtcgagcattccgagaatatgttaagttagaattagattgccatgagcctatcattttcttttggtaaggtcttcagtgctgtcagaagagtcattgtactctgcaatcttt

SEQ ID NO: 1684 - DNA, 700 bp, Homo sapiens
aaataatcagatcctgagcctaattttcagatcggtttgccctgcagttgctggaaataagagtctcctctaaagttgccatgggagttgtcgagcattccgagaatatgttaagttagaattagattgccatgagcctatcattttcttttggtaaggtcttcagtgctgtcagaagagtcattgtactctgcaatctttataattaccattgttctcatataaccctgtcattttatctttcattgtcttgctgtccacctgcccctcatctaaattaaccagagctaaaagcttaagaaattgcaaagccactgcctgccagaagttattatcaacctacttatattcagcaataggttcatattattttaaaatagtgaataatccaatgtcaatgttccatttccaagtgtttgttacctaaaactacatctgatactaattgtcatagccaggtctcttcagaaagcagagcctgaagtcaggctctgcttgccttctatgcctggaaattaagggtgctgtgttggtgttggtgctgacaaagagacagataggaggcagtgagggcaatctgagaaggcacacaaatatgtatccaatacaaacataaatttccacaactgatgcaagaagacatagaaaaatctaaacagatctagaaccactaaagaaattaaaccagtcatttaaaatc

SEQ ID NO: 1685 - DNA, 700 bp, Homo sapiens
cttctatgcctggaaattaagggtgctgtgttggtgttggtgctgacaaagagacagataggaggcagtgagggcaatctgagaaggcacacaaatatgtatccaatacaaacataaatttccacaactgatgcaagaagacatagaaaaatctaaacagatctagaaccactaaagaaattaaaccagtcatttaaaatctttcttgaaagaatacaccaagtccagatagttttctaggtgagtccttctaaagtgtcaggtcacatataattccaaacatatataaactcttatagaaaataaacaaaatgagatatttcccagctcattttgtgaagctaatatgtagcatacgaaagtcagaggaggaaaatatatgaaagaaaaattatgatcccatactcactcatgaatgtggacataaacattgttatcaaagttttataaatccaaatccagcatgtataaaaagacattacataacaactaatgtaatgtctttctttcaggaatataaaattaagtgtcaggaatatgaaatattcctttatttcaggaatataaaattaaatgtcagaaaatctattaatgtaatttaccacattaatcactttttaaagagaagaatcaggctgggcacagtggctcacgtctgtaatcccagcactttgggaggccgaggcaggtggatcacctg

SEQ ID NO: 1686 - DNA, 700 bp, Homo sapiens
gtctttctttcaggaatataaaattaagtgtcaggaatatgaaatattcctttatttcaggaatataaaattaaatgtcagaaaatctattaatgtaatttaccacattaatcactttttaaagagaagaatcaggctgggcacagtggctcacgtctgtaatcccagcactttgggaggccgaggcaggtggatcacctgaggtcaggagtttgagaccagcctggacaacatggtgaaaccctgtctctactaaaattccataattagctgggcatggtggcgggcacctgtaatcccagctactctggaggctgaggcagaagaatcgcttgaacctgggaggcggaggttgcagtgagttgagatcgtgccattgcactccagcctgggtgacaagagcgaaactcagtctcaaaatacaaaacaaaaaagagagagagagagagagaagaatcacatgatgatatcaatgcagaaaaagcattactgaaattttacattcatttattataattactttttaacaaagtcaaaatagaaaggaacttttttaacctgataaacttacagaaaatactgtgctcaatggtaatatgttcaaatcatctctttaaaaaaagaataatgcaagaatacctgcaggaccactctgtgcactgcacaatcccaggaagcaccatttacatcagagacatta

SEQ ID NO: 1687 - DNA, 700 bp, Homo sapiens
acattcatttattataattactttttaacaaagtcaaaatagaaaggaacttttttaacctgataaacttacagaaaatactgtgctcaatggtaatatgttcaaatcatctctttaaaaaaagaataatgcaagaatacctgcaggaccactctgtgcactgcacaatcccaggaagcaccatttacatcagagacattatatatttgagtatgtatgacaatttcataccagatagaagtatctttttccaatttgcacagaggctttatatgatgtactagtgtccctggagactaactttgtttccattaaaaactgaccaaaggtcccagcctttgcaaaaagatcattcatattaatagaactaataaatatgaggattataaaggaagaaacaaaaatcatatatatatttgcagatgatacactatgataaaaatggaactcaaaaacacgtagagtcagtcaaatgattataaggaataagagagttcagcaagttgctggataaatatgcaaaatcaattacaaattatacattaccaaaaaacagataatgtaattttaaagaagacatcattacaaataagtataagcattattataatacttataagactataaagtgccaaagggtatgggggcacgtgcttgtaatctcaactacttgggaaaggctaaggcaggaggatcattt

SEQ ID NO: 1688 - DNA, 700 bp, Homo sapiens
caagttgctggataaatatgcaaaatcaattacaaattatacattaccaaaaaacagataatgtaattttaaagaagacatcattacaaataagtataagcattattataatacttataagactataaagtgccaaagggtatgggggcacgtgcttgtaatctcaactacttgggaaaggctaaggcaggaggatcatttgaggccagaagtttgaggctgcactccagcctaggcaactgagtaagaccccatctctctctctctaaaagaaaaaaaaaagaaatgtaaagtgccaaagaataaatctaacaaaacatggaaaacatttaaaaactttatgaaagatagtaacaacagcaaatgcagagacctagtatgtccacggatcaagacttgacactgtaatttgcaaactgatttatacatttaatgtgactcctatcaaaatcccaagcatttttttcatgatcatactatgctgattctaaaatgtacacgggaaaatgagagtccaagaatagccaatacaattctaaagaaggagctgaaaatgggagaacgtggccgggtgtggtggctcacacctgtaatcctagcactttgggaggccaaggtaggcagattgtctgagctcaggagttcgagaccacaatgcgcaatattgcaaaaccccatctctagtaaaaatccaaaaaaa

SEQ ID NO: 1689 - DNA, 700 bp, Homo sapiens
cgggaaaatgagagtccaagaatagccaatacaattctaaagaaggagctgaaaatgggagaacgtggccgggtgtggtggctcacacctgtaatcctagcactttgggaggccaaggtaggcagattgtctgagctcaggagttcgagaccacaatgcgcaatattgcaaaaccccatctctagtaaaaatccaaaaaaattagctgggcgtggtggcatacacctttagtcccagctacttgggaggctgaggcatgagaatcgcttgagccggggaggcagaggttgcagtgagctgaggttgcaccactgcactccagcctgggcaatagagtgagaccctgtctcaaaagcaaacaaacaaacaaaacaaaacaaaacaaaacaaaacccaaatgggagaacttgtcttgctagatatcaagccttaataattaagtgtggttttgacaaggggttataacagtagttcccaacagagggtgattccccaaccccaagggaacatttggcaatttggggttgtcagaattggaggggaaggaggggatgctactggcatctactgggtagaggtcacggatgctgctaaacatcctacagtacacacaacagccctccacagcagaattctcccatccaaaatgtcagtagtggcagggttgagaaatcctaggggtagacagatagaccggtga

SEQ ID NO: 1690 - DNA, 700 bp, Homo sapiens
caagggaacatttggcaatttggggttgtcagaattggaggggaaggaggggatgctactggcatctactgggtagaggtcacggatgctgctaaacatcctacagtacacacaacagccctccacagcagaattctcccatccaaaatgtcagtagtggcagggttgagaaatcctaggggtagacagatagaccggtgaaaaactaatttaaaaacagaaaatatgacctgggagtgggcttatccagcaggaaacagtagggacactcatattgagtaacttaaggcagtttatttaataaagggaccattataaaagaacagagtgtagggaaaacaaagcccttggcgactggtaacaggaactgcaacaggagagggactatttactgaaactcagagatacagagcacacagagatacagagcactacagcgatacagagcactacatgcagacggccaattggcaagagctgggaccttaagtcaagggacacaaccagcttgcagcaaccttgcaaggagagagctaagggcatacataccttgcttcacgcacctcctaccttttgatcacctgtcaatgctcccatggtcaaacccaatgggaacctgtgggcaaataagctattaatgtagttcatactggtcagcctcccaggacacagaggctaaaagggggtggagagcagatct

SEQ ID NO: 1691 - DNA, 700 bp, Homo sapiens
acaaccagcttgcagcaaccttgcaaggagagagctaagggcatacataccttgcttcacgcacctcctaccttttgatcacctgtcaatgctcccatggtcaaacccaatgggaacctgtgggcaaataagctattaatgtagttcatactggtcagcctcccaggacacagaggctaaaagggggtggagagcagatctggagaggcaaataggagctttccagatggaatggaaggatttcataaataaaacccccaaagagcagagcaccaaggaaaagactgatacattcaatattcatcaaatttaccataaggagagtgaaaagacaaaccgcaagctaggacaaatatttgtttcatatataaatgactaaggattagtttcaagaatgtctaacaaaatcctcttaatcagtaagaaaaagataaattacccactagaaaaaaaaaaggtaaatgacatgaataagtatttcttagaacaggaaacacaaatggccaataaacatataaagagatgttcaaccttattagtagtcaggaaaatccaaaattaaaccacagtgagataacatttcacacccaccagactggcagaaattaaaaagtcagacattacaattcttgcccaggatgtaaagtaaaaggaattcttacacattgtccacaaaagagtaaaatggtacttttgaaat

SEQ ID NO: 1692 - DNA, 700 bp, Homo sapiens
atggccaataaacatataaagagatgttcaaccttattagtagtcaggaaaatccaaaattaaaccacagtgagataacatttcacacccaccagactggcagaaattaaaaagtcagacattacaattcttgcccaggatgtaaagtaaaaggaattcttacacattgtccacaaaagagtaaaatggtacttttgaaatgtagttcttagtaaaaaattgaacgtgcacgtaccttatgaccccgaatttcaacctagtgcatattctagggaaattcttgcccatgaacgtcaggagagataaacaaccacaatcatagtagactgttttcttaaataaacttattttaggaaaactttcaggtttacagaaaaatggggaagatagtacagaaagttcccacgtactccatatccaattttccctattcttaacatctttctttttttttttttttttttttttagacggagtgtccctctgtcactcaggctagagtgcggtggcacaatctcagctcactgcaatctctgcctcccaggttcaagcaattctcttgcctcaacctagctgggattacaggcatccgccaccgtgccctgttaatttttgtattttcattttttagtagagatggggtttcaccatcttggccaggctggtctcgaactcctgatctcatgatccaccacctcgg

SEQ ID NO: 1693 - DNA, 700 bp, Homo sapiens
agtgcggtggcacaatctcagctcactgcaatctctgcctcccaggttcaagcaattctcttgcctcaacctagctgggattacaggcatccgccaccgtgccctgttaatttttgtattttcattttttagtagagatggggtttcaccatcttggccaggctggtctcgaactcctgatctcatgatccaccacctcggcctcccaaagttctgggattacaggtgtgagccacagcacccagtccttaacatcttacattagtatgctatacatgtcacattaatgaatcaatatggatgcattattgttaactaaagtccatatcttattcagatttctttagttttacttactttttgcagcatgttcttaacaactaaaacttttaaaacccccaaaatgggccaagagcagtggctcacgcctgtaattccagaactttgggaggccgaggtgggcagatcacctgaggtcaggagttcgagaccagcctggccaacatggtgaaagcccgtctctactaaaaatacaaaaaaaaaaaaaaaattagctaggcatggtggcacatgcctgtaatcccagttactcgggaggctgaggcaggagaatcacttgaacacaggaagcagaggttgcagtgagccgaggcggcaccattgcactccagcctgggcaacaagaacaaaactccatatc

SEQ ID NO: 1694 - DNA, 700 bp, Homo sapiens
ccaacatggtgaaagcccgtctctactaaaaatacaaaaaaaaaaaaaaaattagctaggcatggtggcacatgcctgtaatcccagttactcgggaggctgaggcaggagaatcacttgaacacaggaagcagaggttgcagtgagccgaggcggcaccattgcactccagcctgggcaacaagaacaaaactccatatcataaaaaaaaaaaaaaaatctgcaaaatgtccatcagtaataaaatagataaataaattatggcttactcatttagaagattatagtaaagtaaatacagtaaataaataaactacagttatatgtatcaacatggatgagtctgaaaacattttgttgaccagtaaaagcaaatattaaataaatacatccaacatgattccatttataaagagggcaaaaataggaaaaatgaaatcatatataattagaggatatttatatatataataaaacaagaataacaaataaatgattaaccaaaaaaataaggataatggttccctttggtggggagggacatggaagctgttggagggacaccttcatggggagagggaatgttcccttcagttgggtggtggacacatgggtttttgttatgttttaaactatacatagagattgtaatttttttgtatgtatgatgtttcataataataattttaaaggctctgat

SEQ ID NO: 1695 - DNA, 700 bp, Homo sapiens
accaaaaaaataaggataatggttccctttggtggggagggacatggaagctgttggagggacaccttcatggggagagggaatgttcccttcagttgggtggtggacacatgggtttttgttatgttttaaactatacatagagattgtaatttttttgtatgtatgatgtttcataataataattttaaaggctctgatccctgctcttttctttccccttgaaagcaggttgtctaaatagtcctcatcctccaacattctggcttaagggaaaaggtgacactttagagtcagagcaaacaggaaccccagccctctgtgccccaaccaaagaaatgtgattatgtctcttatcatcttcttcaagccccaccacacatcatgatgcttcctgtttctcagaagctgaaaaaggtgctgacataatgtaatgagtagaatcgaggcagtatacacggatctacccagagccatgtgtgtcacccgaggggcaggttggactctcagctgtggttgggaacataggccaaatctctgcctttaggtgggaaatgaccccaaatttgaagattcatggagcagggtgactcttgctgttaagaatgagagactcaccgtcatcagccccaagagatgccttctgcaacagcgaaaagccacctcttggcagatccctttacgtgggtacagctggact

SEQ ID NO: 1696 - DNA, 700 bp, Homo sapiens
  misc_feature (1)...(700): n = A,T,C or G
tggactctcagctgtggttgggaacataggccaaatctctgcctttaggtgggaaatgaccccaaatttgaagattcatggagcagggtgactcttgctgttaagaatgagagactcaccgtcatcagccccaagagatgccttctgcaacagcgaaaagccacctcttggcagatccctttacgtgggtacagctggactgggcactgggatccagctggggcctgggaaactgccacactggcaccccctattcctccacagtcatccctcacttgtctgttcatttggttgtttattcattcactcagcaaatactcacacagctgcaatgtgccaggcactgttctaagtattggtggcacagcagggagcaggacatagccctgctctagcagcatcatacacatttaggagggtcagacaacaaacaaataaaacaactataaattgtggtaagtgccttcagtgcaagtagtagaagcaaaacaacccagtgttaagatgctaaagtcaggctacctggntttaagttctgcttctactgctacctgccattgggcaagttaattaatctttctaggagtcanttttcctttctatagattggaagtgatcatcaaacctactgaataggattgattgaagatttattctttccaaaaatatttattgagcaccactatgtgccaggcaccat

SEQ ID NO: 1697 - DNA, 700 bp, Homo sapiens
  misc_feature (1)...(700): n = A,T,C or G
ttaagatgctaaagtcaggctacctggntttaagttctgcttctactgctacctgccattgggcaagttaattaatctttctaggagtcanttttcctttctatagattggaagtgatcatcaaacctactgaataggattgattgaagatttattctttccaaaaatatttattgagcaccactatgtgccaggcaccatgccaggcactaaggattaatagtgaaggtgacagacaaggttctgccctccaggaacatacatgatagcagaggaagagtcactggacaagcaaaggccatgtcggatgtgataagggctagggactaacgtgatccagggagattcaggaagtgccagggagagagggccactttatatgtctgacaaggtgacatttgagagctaaatgatgaaaaggagccatctatgtgaaagcctgggggctggcgatagttaaacagagggacagcaagtgtgaaagtatagtagcaggaatgaagttggtgtggttgaagaacagcaggaagacagatggctggagcacattagcagggaggtaggagatgaggctagggagggaagagagggctcatgcagactcatgcaggccagagaaaggactttgcatttcattctagtaatgggaagtccctgagggtttaaagcagaggagggtcagatgacttacttttttttt

SEQ ID NO: 1698 - DNA, 700 bp, Homo sapiens
  misc_feature (1)...(700): n = A,T,C or G
gaagttggtgtggttgaagaacagcaggaagacagatggctggagcacattagcagggaggtaggagatgaggctagggagggaagagagggctcatgcagactcatgcaggccagagaaaggactttgcatttcattctagtaatgggaagtccctgagggtttaaagcagaggagggtcagatgacttacttttttttttgagacagggtctcactctgtcatccaggctggattgcagtggcaccatcacagctcactgcagcgtcaacctcctgggctcnggtgatcctcccatctcagtctcctgggtagctggcactataggcatgtgccaccacgccaggctaatttttgtattttttgtagagatgggatttctccatgtttcctaggctggtctcaaacttctgggctcaagcaatctgcctatgttggcctcccaaagtgctgggattacaggtgtgtgccactgcacccggcaacttacatttttaaaagatctctagcttttgtgtgggcacagattaggttgtaatgttcgaccagagaaacaagttaggatgctattgctccatggtgagtgacatggttatacagggtgaatggtgcagggtgggctggaggagaagacagaatcctacagtgcagggcattgtagtgggcatctgatctctctcttctcccacctctatgcagc

SEQ ID NO: 1699 - DNA, 700 bp, Homo sapiens
  misc_feature (1)...(700): n = A,T,C or G
agatctctagcttttgtgtgggcacagattaggttgtaatgttcgaccagagaaacaagttaggatgctattgctccatggtgagtgacatggttatacagggtgaatggtgcagggtgggctggaggagaagacagaatcctacagtgcagggcattgtagtgggcatctgatctctctcttctcccacctctatgcagctgcttctctctcctcagaatccagacccaaattttaccttctgctgggaaagccttccttccctattttttgtttgcaggtggcgggggcnccctggacctgggattcccacgttcttcctcctaacttgctgcctcgtggccctagacccctcttgtgtaacacagacatcagtcaggctctctcaggctcctaagacctggacgacaggctcaagctcctatttgctcacgtgcaagtggaaagcttttgccagggtgtttgcaagttcccttgtgcatgactgtgcatgactagcactgactctctcctgatacagcatggttagatctgtgtgtggctcatcaggacattcaanaagtaatgcccctgttctgcaccccacagaaggcagtcctttccactgagtcccattcacacagccaagctgaccatcacccggatctgcctgtggcagaagcaacttcaaagtgagcgctagtgctcctattcttgaagt

SEQ ID NO: 1700 - DNA, 700 bp, Homo sapiens
  misc_feature (1)...(700): n = A,T,C or G
actgactctctcctgatacagcatggttagatctgtgtgtggctcatcaggacattcaanaagtaatgcccctgttctgcaccccacagaaggcagtcctttccactgagtcccattcacacagccaagctgaccatcacccggatctgcctgtggcagaagcaacttcaaagtgagcgctagtgctcctattcttgaagtcctgtggtcacgctacagtgatagaacttcttcttcttcaccccctttccattctgtctgcagctttgtgccatcttgccagttccccctctctcttcacccaattgcagtttatttctaatacacagagcaatttctgtagcccttttgtaacaattcattgctcacctatggacccaagatctcagcttcctacctccctctagtggctgatgcaggtatttccaaaaaaaaagtcctagagcaggatcctggctggccacacggctgtccagtgctgctcctgcccacaaggttctaagaggttaaggcttgacatatcagaaaaggaaaggaagcctgtgtgacacagaagcctgggttgagggaggctacgctctgtgtactgtccccgggcagaggcggttttctgggtcacctgcatgtcccaacaccggcctctggtggtcggcagatgttaatcctaaaacccttctgtccccacctcagaggtgaagta

SEQ ID NO: 1701 - DNA, 700 bp, Homo sapiens
  misc_feature (1)...(700): n = A,T,C or G
taagaggttaaggcttgacatatcagaaaaggaaaggaagcctgtgtgacacagaagcctgggttgagggaggctacgctctgtgtactgtccccgggcagaggcggttttctgggtcacctgcatgtcccaacaccggcctctggtggtcggcagatgttaatcctaaaacccttctgtccccacctcagaggtgaagtacctgtgcactagccttccccgtctgggtcccccaaggcccccacactgggcgcacagggtacagggaggagccaagccntctgctccagttctgccttctgcgcaggagccctttgacttctgggagtcaaccccagctcacccaacaaggagatagggcaggtgggagacaccctaagctcagaaggcctacaggagatggagagcacccatcctccacctctactccttctccagaccactccacacctcgcagcttcttgctcctcaccctcgcatttggcccagtgggcaccaagaacaagncagggtgactggctaagctggggccaaactcactgacagaattggaattgtgtcaaaacaccacttttatgtcctcacctttcaggcctgcatcagtgtgagctctgcagagaaaggggcctgtcttactgaaccctcagatcccagcacgctgctgtcctatggaggcatccatgcatatcagcagcagaat

SEQ ID NO: 1702 - DNA, 700 bp, Homo sapiens
  misc_feature (1)...(700): n = A,T,C or G
gaacaagncagggtgactggctaagctggggccaaactcactgacagaattggaattgtgtcaaaacaccacttttatgtcctcacctttcaggcctgcatcagtgtgagctctgcagagaaaggggcctgtcttactgaaccctcagatcccagcacgctgctgtcctatggaggcatccatgcatatcagcagcagaatgaatggatggagggaggaatgaatgtaatgaatgctgctccttcactgccacctgccttctcaccctgcccctcgagggcagaatactatggcttttcttttcttcttcttcttcttcttttttttttttgatgaggtcttgttctgttcccaggctggagtgcagcagtgtgaacagatgcatggctcacngcatcctccacctcccagactcaagtgatcctccttcctcagcctcccaagcagctgggaacaaaagtgtgtgccactatacctggctaattttttagcttttgtagaagggtctcactatgttacccaggctggtctcaaactcctggcttcaagccatcctcccaccttggccttccaaagtgttgggattacaggcgagagccactgtgcctggcttgctatggctttttagagtttctcacccaattacctcctctactcaatttctagctcccatttttggttcctccatggcctttgtccc

SEQ ID NO: 1703 - DNA, 700 bp, Homo sapiens
gaagggtctcactatgttacccaggctggtctcaaactcctggcttcaagccatcctcccaccttggccttccaaagtgttgggattacaggcgagagccactgtgcctggcttgctatggctttttagagtttctcacccaattacctcctctactcaatttctagctcccatttttggttcctccatggcctttgtcccccaaatctgcccttgttgtcagagcactggactaggagtcaggagtaccaggtttgtcatcagttagccctttgtgtctcatggccccatctgtaaactggaatggggttttctcttgatctcaggatgtaagtgggatggaaaagtgcccaatctcacttaagactgtggtttcctgacccagagtttcagttctgtcttttctttttcagtatcaggagtgttacatgcctgttatcctaaacacacactcacactcataaaggtataaaactgagtcctcccagaagtattatctgtcagttgggtatctgttgttatgttacagatgattccttcactccttacaccaaccctggcagttgggtatgtggattacccatgtgtattagttcattctcacactgctataaagacatacccaagactggacaatttataaaggaaagaggcttaattgactcacagttacacatggctggggaggcctcaagaaaca

SEQ ID NO: 1704 - DNA, 700 bp, Homo sapiens
gtcagttgggtatctgttgttatgttacagatgattccttcactccttacaccaaccctggcagttgggtatgtggattacccatgtgtattagttcattctcacactgctataaagacatacccaagactggacaatttataaaggaaagaggcttaattgactcacagttacacatggctggggaggcctcaagaaacaatcatggaagaagccaagagagaagcaaaggcacgtcttacatggcagcagaccagagagaccgcaaatgggcgaaactggaacagccccttataaaaccatcagatctcgtgagaactcacttactatcacgagaacagcatgggggaaacctccctctgatccaatcacctcccaccaggttccaccctccacaggtgaggattatgggaattacaattcaagatgagatttgggtgggggcacagagccaaaccatatcaccatgtttcatatgaagaaagtgggaattagagaggccaaggaacttgcccaaggtcacatgctgggaatggtaggctgcggtaccgcaggaagacataagatgaaatgcatgaagaacattctgaaaaaagtgaaattttctccagtgcttggctttatcgtgagctgatcttgtgatttctgtcactcaggctgtggatgcaagttaaaaagcatcagctgtaaccagtcacag

SEQ ID NO: 1705 - DNA, 700 bp, Homo sapiens
gccaaggaacttgcccaaggtcacatgctgggaatggtaggctgcggtaccgcaggaagacataagatgaaatgcatgaagaacattctgaaaaaagtgaaattttctccagtgcttggctttatcgtgagctgatcttgtgatttctgtcactcaggctgtggatgcaagttaaaaagcatcagctgtaaccagtcacaggaggatttctgagttgggctggggtaggggagagagatttctgctttgggtccccatagtttctgtaactctggtttagtttccttgtcactggatcctgcattccttgagggcagccattgtattttatctttcagctttactaaagtatatgaaaagccgggcatgctaaagtgtacaattcaataagtttagaatgtgtattcacctgtgaaactatcagaacaatcaagatactgaacacattaatcacctccaaaatgtcctcatgccttccagcaatcccttcttcccaggcaatcactgacctcgtttccgtcactatagattagttggcattttctagaattttataaaaatggaatcatagtctagtttctttctttctttcttttcttttcttttctttttttttttttaagagtcttgttctgttgcccaggctggtgtgcagtggcgcaatgttggctcactgcaacctctgtctcccgggttcaag

SEQ ID NO: 1706 - DNA, 448 bp, Homo sapiens
aatcactgacctcgtttccgtcactatagattagttggcattttctagaattttataaaaatggaatcatagtctagtttctttctttctttcttttcttttcttttctttttttttttttaagagtcttgttctgttgcccaggctggtgtgcagtggcgcaatgttggctcactgcaacctctgtctcccgggttcaagcaattgtcctgcctcagcctcccgagtatctaggattacaggcgcgtgccaccatgcctggctaatttttgtatttttagtagagacagggttttgccatgttgtctagactggtctcaaacccctgacctcaggtggttagcctgcctccggcctcccaaagtgctgggattacaggcgtgagccaccgtgcccggccagcctgccttcattgacttggaataattattttgagacgtatccatgt

SEQ ID NO: 1707 - DNA, 581 bp, Homo sapiens
tacagcttatttcatactctcctactgttcaaaatctgttgtgcaaagtaagagaacaaagagaagtgatgcttttcagaaaaaaagagcaaatatatgtggacaggaaggaacttcgttgtccatgtaacagatataaaattgactgtaaaaggcatgtgctcgcaatgtcaaagtctctatgagtacagaaggacacagactgtattacctgtgtctaacttgtgctgtttctcttgtttctcctggttgacttgttggacagttcgatctaagtctattccttgtagcttagctgcttgttgtgcaatttttctttcaacatctttaagttccatcttaagaatataacaaaatgatttcctttaataaacttactgcattattcaaaatctttaaaaattaattgctcttatcatttattttttaaatctaaacttataaaccatttctagatacaattttagcaaagtttaataggataaaagtgaaattaattatcagcaattcaaatgatgtaaacaaaaggaagctgactaaagatgaaaaacaaacagaactgtcttaatttttaaatttat

SEQ ID NO: 1708 - DNA, 632 bp, Homo sapiens
ttctttaggactgaactaaattgctggtatcactgctcagaagagtcttgaacttgatggagcttatgttgagaaatacagtttatttaaaatttttatcttttaattccatttttccatgaactttctgaagtctccttgtatgtaagaactaaagtttatcaatataacataccatttcatgacaataaattattttaaaacaattaaacaggtaagcatgaaataagagatttctattacatctccaaatgttgcaacttacttcaatttggcaagtctgtccctggtctgattaatttcttttgatttactatgtagccagtcttcaagctgttttttgttgggaaaatatcccaacagtgaggttaattcatcactgtgcctagattttatttttctgatttgttcatctttgtcagcctataggtaaaaaaaaaatcttttaaaaataaagtctatatctccacattatatcaagaacaaaaataaattctagactgactaaagttctaagcttaaaactataaaaatatgaaaataaaatataaaatttcttaaagttcttaaagtcttcaagtggggatggtctttctaagccttaagagtggagtaccaagtcgaacaatata

SEQ ID NO: 1709 - DNA, 711 bp, Homo sapiens
aaggtctgaagctttaaggtctgagtacagtatctttaaaaagctccctatgtgattctaattttcaggctatcgggttgtagaaccaaagagtcagaagatcaagatattcagatgaattcattttacatgagaataagacaaagttgatgtttttattaaaatgctataatcttaggatcaaaaatagacaaaatacttctaaaagtattatatcttaaaattattagattattcaaacaatatcttacagcttttatgagctcctggtccagttcaagaatcctgtctgaagatccttccaactgctgtaattcatacttcacatttttcagctcattctgcttcttacttaggatttctgattttaactcaattattcttcccagtccagttttcttatctcttatctcatctatctgtttttgtttcagagtctctttttctgcaaagtcattctaaatgcatatgtaaagaatgagcattaataatttactaaacaatttaagttttttaattgcaaaaggaatatatgtacactgaagaaaatacaaaaaagtacagtcgtgtgttgctcagcagggatatattccaagaaatgcatcattaggcaattttatcattgtgtgaacatcagaatgtatttacataagcctacatggtatagtttaatacacacatagactatatggtatagcctattgtttatgg

SEQ ID NO: 1710 - DNA, 571 bp, Homo sapiens
aaaaaaacccagaatacaaaattaagagtatgacatcagctatataaaacagtatttaaaggaggaggaaaacacatgaaaatgtcaacaacggttactactgggtgctaaaactgtgtggggctgactttcatttctctttatagttttccagtgccaagttttctataataagctattatcatttttataattataaaaatacaaaattgtactagcaccattaccttgggatcgtgtacaaatgtatttcctttggttccaggagggaaatctccagtacaaatatattttagacattcaatgatggtctaaagaaatagaaaattacattatttcgttataagagaaccacagaagtttaccataaaatatgaattcattacaaaaatattatttatcatggaaactataaaagataaaatctgacattataaaacctgtaataaaaatatgattaagtgttaatgctgtaagttcacagaaatgctatataactaagaagttatcctaatatgaagaattgttacttgggaaaaaaataattattttcaactgaaaccctttaaac

SEQ ID NO: 1711 - DNA, 1249 bp, Homo sapiens
ggcgcttcccaaagcttgatcctgggactcctggaatgggggtagtggtggggtggattggagacccaggaagcggggtcagttcatgtcaaaactattttccttttcattctcattctctctctaacgttcgtgtagtaatttccagtgatcacataacatgtgatgacgccattgcagtggcggttaatggaatgtgcgcatgtgtattcttgcgcttagaaataccaattttaatttctaattgagtaaatgttgataattataactcacgtacacgctctttgaggtcccccgtaattttttagtgtaaaggcgtctttaagaccaaaagtctgggaactaaaactaaaagcagtctgcaaatatgaagaatgtagaggtaatccattccgatcagtgctcccagcaatagatatctttaaaaataagggaaagagaagttacctgtctcagaagtaactgagaatattgctttcttggaaacaaacttaatggagggatatcacatttaagggcctagagaaacatacataaaaattactgaaacaatagtggaggacatttaaatgaaacacaaatttggaattactgtagtggtataatttgcctctgcctgccttggaaaaatgtaggaaatgtttctccagtcatacaatcccaagcaaataatttacagaacctaatacataaatgtatgtgccaaaggatgcaagtggggaagaccagtgagaaatagtctcttgctgtaccaggttaaaaaaaccggaaagtgtcagttattacaaaatagttaaaataactaatggaacaaaacattaaaattatataggaatgtcttacttggcaaagcaaatgtaataaaacaatgggaaaagacgaaagacctttttttattttaaaaattgtaaaatacacataaaatttactgtcttggccaggcgcggtggctcacgcctgtaatcccagcactttgggaggccgagacgggtggatcacgaggtcaggaaatcaagaccatcctggctaacacggtgaaaccccgtctctactgaaaacacaaaaaattagccgggcatggtggcaggcgccgatggtcccagctactcaggaggctgaggcaggagtatggcatgaacccgggaggcggagcttgcagtgagccgagaccgcaccactgcactccagcctgggcaacagagcgagactccgtctcaaaaagaatttactatcttaaccaagtgtacat

SEQ ID NO: 1712 - DNA, 696 bp, Homo sapiens
ggttcccgccttagctccggccggagcatcaggtggggcccaagacacccgcagactaggctgccgcggcctctcccggatccgacgggtctcccgcagcttgtccacactctggttggtggtcccagcacatttgcaggctccagcgggtggagacggcttggtgggggagatctctagggcgcacgccgtgccccacttcccccttacgggaaaggctttccagcgcgcggacccaggagactctcacctaggctcggccccaggctccaggggacacgcagaggcccgccgggcaccagccccgagccccccgacactgccgtcccggtcccccaacgcgcggactacaagtcccagcagtccccgcagctggcacctcccgcctcgccgcggagacccccggccgtccaagcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcggtgagggccccgct

SEQ ID NO: 1713 - DNA, 1121 bp, Homo sapiens
ggccgtccaagcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcggtgagggccccgctgggccacggcgcgcgcgggaggcgcggggcgcaggaggggccgccctgcagctggcggggggcgcgaagcgggctgtcagcgcctcacggccgggcctcgacaccgggccagctcgaggaccccggcgcgggctctcggccgcgctatcggggggtcccggagcgtcgggcggcctgccttgccgggcggctggtcggggtcgcttcctggggcgcaggcaaggctaacccctttcgcgggaaggagcaaagacccgcctggctccgggcaggtgcgaagatagagtggcgcccgcggggccgcaggtgagggtccgggacactccggaccctatcgcccagggtgtttctttctgcacacttggggaagagtcctagccgcacaggtgctgcgggataggtacagccggggaggatggaggccccaggatccgagagagtctcccacacgagcccaggacagttgcagacttgagtcctgaagacccttggcctgcttttccttcctcccccgctcccctctgccccgctccccacgccggaatcctgggtgcgactccaggcaggtcaggcctcagtggtcgggtctgcggcagccattcgccaggagctggagggattccagactcagcccagtgggcgtttatttgggctccagtccaggtcctcagaaggttgatgtccctggtggtccctgcaggggtctcactgggcctgagcctgccgacagccaacttactaaaggctttcataattcactcgcgggagggaggcctttggggggttgtatctggacatcccctgctgtctaaggctggatctgggtgtg

SEQ ID NO: 1714 - DNA, 632 bp, Homo sapiens
actacctatttagtatacaagaaattaactactgtacatcactgtgactttagttaataacaatatataattgctaagagagtagattttaagtgttctcaccataaaaaaattgaagtaatgaacgttaaatagcttgatttagccagtccacgatgtatacttatatcaaaacatcatgctgtataccataaagatatacaatttttgtcaattaaaaataaaatcaagttaccttcaatggatcaagttcattctcataggatttgacaatttcctttgaagatgttaactgggcttccttacttgtaatctgatcacgaatctcacaagctttttccttatattgcttcagatattttagttccatttgatattcttttactttctgaccttgtgtctgacgtacctgccgaagtgtttctaaggctttaatgtatctttgaagatatgaaacaaaaatcaaatttctggcaaagtaaattatggtatatattcatacagtgggatattatgctgtcactaagattacagttacaatgagtttttaataacttgtaaaatgcctatgacataatggtaagtgaaaaaaattacatttatactgtcaatcaggtaaataaatatacgca

SEQ ID NO: 1715 - DNA, 510 bp, Homo sapiens
tggatgagaggtagtaactgatgacctttctgctttttaaattttttctgttaaaaagaagcatccaaattgcaaacacagttcaataacttaatggactacaaagtctatttaagggttacaaaccttgttgctgaaaaaatctcatcaaacttttgcttcaaagcctttccttcacttaaaggccaattagaatcttcttgatgacagaaaatgacattatttagcacagccttggaaaccccaagagaactgatcatttctcggtcaatttctgcacacttagagctcagactgaccttttcaccatgcctacagaaaatgaaaatcaagaatatatgtaaaataaccttcagtgtatctattctattgcttaatcaattcatactgtacttctttaaaagaataaaaaaaaaggcccttcacctatcccgttagaaatggcttcatcatgctaaaaagtgtaactcttaaactatttaacggttcacagatgaaaagatatgtaaa

SEQ ID NO: 1716 - DNA, 845 bp, Homo sapiens
gaccccattcaactacttcaaattttagttggggaaaccaagtcccagagagagaggtcactggatttataaagttaaaagcagagccaaacatacatctcaccatttctggtcatcctcagatattaatactcagtttttcaaaccacatgcaaggaagtaaattcagaggtaacatttaactatgatttaaaaaaataccaaaaccataaattttcaaggcagtaattatctccttctcaacagtgctttgagaagaagcatgcatttgcactggggagggaggcacagagtcgagtctcggctgtactgctgaaccctgaaggcctgacagaggctgcctggaatgggatgaagagcagcaaatcagaaacaggcaatctgtccaattttcagtgaaacaagtttcatgattttagaacctctcaacatccaaaatcctagacacaatgttcctttgaaagaatatattttcttattgactaagttgatatgagaaataagtttcttattatacactttctgaggacctacatttctatggcatttaaatcttggatatttttaatgaacattgaatcccagggagctaacactgcatttcacaatctctgagcactgatcgatgttctttttaatcctgtagaatttctccacatattcagaacgtcctaaaagctccacaaaatcttcatcatgagtgattaccagaagctggaagttacgctgctgtgagcgactttttattatctgcaacaatatattcagaacatattattagtaaagagcataaccccttctttgatttgaaaagtcaccgcaaaccttgtcagacacatgaactc

SEQ ID NO: 1717 - DNA, 789 bp, Homo sapiens
acacctgtggagccctagggacgcttctgctcctaaggagagttctcaacttcccattttattctccgaaagatgtagcgacctgtaaactgaaggcggctactgaagacttaccgtctttcccgccccattgggtccaaccaaaattgtaagggggctgaagaaagtgataatttgcttatctttgtcctctattccaaaactccgcacgcccagaatgctcatcttttcgatccgggacatgtttgcaaacgtttctaatctcaccagggacctggagtccacaaaggcttaactgaggccgaagcaaggcgtgcacgggacgtgagacccgcgaatctcagggtcaggaggatccgggcggggagcgaggccacaggactgccaaaagatcctgccagccaacagcgggagagagggggcgggggatggagcctttcctcccacaccagctgctttccccgccggtggggagagcggaggcggggaccagcctggggctgcccgccggggacgcaaagccgtagccacaatgcgaccccgcaaccgcgcactcacagcttcctgcctcggccgccctgcggatcacgtgggcctctaggcccgcacgcgtccacgccgctctcctggggcacgccgggaaatcagagtcccgcggtgcgtgcgcagctccgacttccgggtgcggtacggcgaagcagagggctaggtgctgggtgctgttgccaggggcagcggacttccggatctttgctggggatgggcagcctggagaggcactgacttttg

SEQ ID NO: 1718 - DNA, 466 bp, Homo sapiens
aagtctattgaaaaaaatttaatatgctcccctaaacttatagtagaaaacaaccatcaacttacagacctaaaagactgaaaatgaacagaaattcaaatatcatataaacacctactttgttctagtaatgactccttccagagttttaaattctgtctttttgcttttctgagtacacaccatagatctttgcacagctataagttctccattgacatcacgaaattgcagacgaatctgggctctcacatctgtttcttgagcaacctttgaaggaaaacacagaaaaaacttatgttactttaataagcaccagtgttggttctgagaaaaaggcataagcaatcttacccaaaatgagggaacaaaaagaaaaacatccaaaatgagtgatatttttacatgctatccaaaatatagaagaatactgtttaattaatttacaaaaatgatatactatcta

SEQ ID NO: 1719 - DNA, 474 bp, Homo sapiens
agattttatcctaacactaatagaaaaatatgccaaaatggagtccaaccaaaaattaaaacaattcaagtagagaatatgatgcaaacaaaataacaaatactgtatttcaaaatacttgccatcagttggttggcagtttttgcttccccttcttgtctctctctcacaagtttgtgaaaatttttaatctgtctttcactgaatggtccacgctcaaagccatccaattctagctgtgttgccaaagactgaattaatgaatctctagctcggatatgttcttgatggcgatctgcttgcagctgtagacgaccttttaaaaaaaaaatctcataatttttttttcaactggtgcttaaaaagttgagatagctgcagattcacgagttataaaaaataatgcagtgtgtctcttgtacattttgcccagtttctcccaatgataacattttgcaaaactgcagtaaaata

SEQ ID NO: 1720 - DNA, 468 bp, Homo sapiens
tgtatagccttttaagattggcttttcactcagcataagtccttggagattcttcattcatacagaaaatgtataacatcatagtaggaaaaacgaccaaataaacattttgtcctaccctgttcaacaagcagttctgatttttcctgattgagaagcctagattctttatttagtttttccagttcacgatgacagtctaccaatttcctttctttctcccttactgttctctggtgattgtgatataagtcatttagttgctcatcagtcccttgaaaaacctgtgtaacaccaaaataaaaagctttaatgtacaaacataagaaaatatgatcactttgaggtatcaaatataaaccaaaccttattcaatatccttcattttaacatatacatagaagtaacaagatctgtatttgtttttttccaatgtggatggcaaaatggattcaaataaagttcatt

SEQ ID NO: 1721 - DNA, 468 bp, Homo sapiens
atacatagaagtaacaagatctgtatttgtttttttccaatgtggatggcaaaatggattcaaataaagttcattacaataatcccaaaattttgaagcagaacaaaattctaccaccacaaaccttttccattttctcttccagttcactattatctttctccatttgcttctttcggctatccaaggctttaatttcattgtcaagtttcattattttagagagattatgttcaatttcttttagacgattctgaaaataaagaaacattacataaataaaactcactatagcttacatggctgatagatgaagacaagtaagatactccaggtccaggcatttagtaaaagtgatctcatttaaggctaacaataacactgtagagcaggcctagagaaactgaagttcagagacattaagtaacttggcccaagtcctcacagctagtagagagaagcaggaat

SEQ ID NO: 1722 - DNA, 395 bp, Homo sapiens
gctcacttagcctctaaaatatagtcaataccaacttaataccttatagtctatgacttatgagtgcaaggtaggctattttaagtaccagacagtataattagaacaaaaagaaaaatcatactttgtctttggtcagcatctccatttgggtacgtgttgttgtatgatggtttaactgctccatctcctggtcaagtttacgcagggtcctgtctaagtctgctttttcattttggagacttattacttccatttttaaggtttctacattgctgtttttctcagccttgcttaactcacgttcctagtcaataattcatacaaatgcaaaggtgttatatattttgtgcaagaattaaaataatgacaaagtgtattagaaattaactact

SEQ ID NO: 1723 - DNA, 395 bp, Homo sapiens
tgaaatccaagccattaggctccataaccaggtttttaaattccccatccttaacagttacctgtgaatgaaaattcaaaggtgtcaaagtatcctgataatataaagtagacaacttacctcgctgttttgatgatttttcaatttcctctttaagcctgtctaaatcactttcaaaatcctggctaccacaaacatcaaacagcttgtcttcgtaactggacaactgctcttcctttctttttagttcattatttatatgatttttattctgctcagatgaagctagttccttgctaaaataagagcaaatatggattttcattttaaaataggagaaattagtttgaaaatttgagtaggcaaaaacaagacaaattctgccaacaaatcat

SEQ ID NO: 1724 - DNA, 462 bp, Homo sapiens
ggggaattctaaacacaacctgtacctgaatactagctactatttttaactctcacacttcaaattcaagccaccatggaacaagttttattctgccttaaactacaataaacttacctggaacctctccataattgtaacatctgtcaggcatactttggcactttcttcttcaggcattattgtacccaagagtgtttcttgttcttctatgtcgttctttaggcgctgtatgtctctattgacattctgcagtttgtttcttaattctggtatttccttctccttcaaatcaattatgctttgcctaaatagaaaacacaattaaaaataaagtatctgatgtttctcacagttagactgaggttatgtatttttaggaagaataccacagaagtgacattgtgttcttttcagggtatcatatcagtggatatggaatcatgatatcaatatgtctta

SEQ ID NO: 1725 - DNA, 467 bp, Homo sapiens
cttatcatagaagtgatataagacagggcataccagctcagagtccttactgagtaactaccatctgcccaggcatgagatgggtaccttttacaatgtgctgctacatgtacagtgaaggtaaatcccattcttacctcatgggcacaagtcccagcatttcatcacgccgcttttcctttttttttagctctgattctgttgacttgagtttatctggagcaagtcgcagtttagactgcaaatcactgatgacttcttgtaactcagcctctgtctgaaaaactctctgacaaacggggcaacatgactggttttcgtctgttagctgagtaatgaactgggagtaaactgctgtggctccagccagcatggctattttaagaaaataaattatatcaccaatgagaaaaaaacataaaatacagtattctgaatacggttgtatctttttctataaatatatg

SEQ ID NO: 1726 - DNA, 548 bp, Homo sapiens
tatgatcgcagacaagtccctttctcacctataggaattgattaattagtctcatttcttaacttctattgtagatcaagcagcaaaataatttacatcaaatccttgttctaacaagaatttctaatgtcaaaattataccatgaatctgaaaatactatttatcttatgctatttaatttcatgtgaaataagtgtccgacgtggtgctatgaacataagtttaatacagatatttgataagtaaatatataaatgaaatcttactttatcctgtgctattttgttgcttgtattttttttgttgattaattcttctttttcttgctggaacttttccaatgttgtttccaaagggcttacctgctctttagcatcctaaaaatataaaaaagataaagtattatataatattccattatcttactttaggggtcagacttcacagtcttaataaaagcactttctatgtgccaggctctaaaagtcaactcatttgctcctttcaatgaccctatgaggacagtaccatcattttcagtcctata

SEQ ID NO: 1727 - DNA, 626 bp, Homo sapiens
gtaggcggatcaccttagttcaggagtttgaaaccagcttgtccaatggcgaaaacccgtctctactaaaagaacaaaaattagccaggcatggtggtgcacgcctgtaatcccagctactccagaggctgaggcaagagaatcacttgaacccaggagatggaggttgcagtgagccgagatcgtgctactgcactccagcctgggtgacagaacgagactgtctcaaaaaataaaaataaaaataaataattaaaataattttacaaaaaacatgtatggatattcttacctttatctctctgtacaaagactgaacttcagtggataattccacagtctgctcctccagttgctgacgacgttgcaaattagtggatatctgaagtttctcagattttagctcatttgttgtactttttagatgttgaatctgttcctgctggtcctgtataagcttacgattcaattcaatcttactagaaactacacaaaaacatattatcacagtaattaatgtaagggcatagaaaatactatttgtatcattcttcccatttttatcggtctatggaatccacaaatgctatttctgtgggccccacccactgcaacaaaaatacaat

SEQ ID NO: 1728 - DNA, 388 bp, Homo sapiens
gcaaagagcttcccaccattcaggtgtagccttgggtgcttccactgcactgatgtttgtttctctctttcagttacttgggtgagttggctccccaggcttttgagatacctgccttttgtccagcactgcatcgtcctcgcatatccaaggctgtgtctcccttcagcatcaccactcggtagttataattccgccttttatcagaagctgatacattttcatcggcatcagaccgtatttctatgtattcaatatctgacacaggaagaagaatattttagaggaacctatgctctgtagccttttgtcatttacaaacatatcaagtaagcctaggaacaacagatgaggctgacattaccagaggaaaacaatggctggtgtg

SEQ ID NO: 1729 - DNA, 471 bp, Homo sapiens
tgccaagataagaattcttagaaaatctcaaagacatgcttagaaaggggtccagggaggtaatgctggcatgatgagaggtcataaggggaagagctgcggagagggctttggaaagagcatttgtgatacaccatggtactcaccttgtccacgataggtacttcgccacaggtcacgtataattttattgatttcttccattttcatactgtgaaatttcattattgctctggaaaaggaagtcattggtacttcatatatataaaaaataattatgtgtaatagtaatattaaaatacataaaatatataatatataaaaaatagaaatataaataacttcctcaatattttcaatggtaaaagtagaatatagtaagagctacaaaaataaacagcagcaaaactttgctgcttggctaatactgaaaattggcaggcttatttctagtgctccaggggtaccctt

SEQ ID NO: 1730 - DNA, 428 bp, Homo sapiens
gatgactaaagtatgttagttaatattaactgcaataagaaaatccccagtctaatacttactggtcaagagtcttataataaatatccagatccttgttcacaagttctgttgtcctcataacaatcatcatttctctatacttttcctcagcatcccgaaattgtggttctcgaagttctttcttaaaatgaataatttcttcttcataacctttctgtcgccctaatgccaaattatgatttctttttatattgtctatgttctcttccaacttctgatgttcactgtaaaaaagaaaaatgacaaatgaggaccattttttagcttttaacaacctgaagtggaaaagtcatagatttctttagataggttaagtatcattctccttagcaatcagtatattataacagagtctctccttgctt

SEQ ID NO: 1731 - DNA, 395 bp, Homo sapiens
acactgttcaccttctagtaactctcaaaggataccaggctgaggctaaaattcttttaaaacaggtatttaatattcttcacattccagtaataaagacgtttatttaaactgaagattattttaaaagcataccttttcatttgcaaaacctgcatttgacccatttccttcaaatgttgttttctttcttcttcaacttcttttagttcctcatttctttttcttaaagtaaggttatcttgtagccacctttcttgtatctaaaggtaaacattaaattagttaacaaaaataaccaagttactaacatgaaatctgtaacaggcaactggtgacagcaagtgccatttctgtcttacttagaatcatgtgaaattcaacagagggagaat

SEQ ID NO: 1732 - DNA, 604 bp, Homo sapiens
gtgtgagccaccacgcttggcctctttcctttttgcatttctattcaatggatcttctattgaaaataaaactatagaaaagaatgtcataggtgtaagtgatatcataagcaaaacagacctaccttctgtgtatcaatatcttgtctcatgagtctcatatcttcatttatcttttctttgtgtttctcgcattcacttagttgagctattactttattaagttcagtttctttttgctacaaaaaagaaaattctttaagcacatgaataaaaatacaatcaaataaataattttaagttttaaattaccttcttatagtcgtctttcccatcttgaatataattctcaatgtctttcatatagccatgaatatttttaaccttctctttaatatcattcagctgtagaaaaatattcattaaatttacactggttgtacttaagggcacataacaggagagcacagtaaaacactggctgggaagttatgaacattgggttccagtttccaccactactgaattttatgatcgcagacaagtccctttctcacctataggaattgattaattagtctcatttcttaacttctattgtaga

SEQ ID NO: 1733 - DNA, 376 bp, Homo sapiens
tatcacaacctgtccccaaatgtgagatacttactcaaccagagcatgtgcaagagatacttactcaaccagagcatgtgcaagagattcaatgttttctcggtcaagatttgttgttggctcatccaaggcaatgatgccacagttgaggcagaacgtttcagccagggccaggcgaatgatgagtgaggctaatacctggaaaaaagcccctatgtgagaagcccagcacagaccttctcatctcatggcaggcaagcagtcctgacatgatcttttcagcagggaaaagtgggaaacgtcacaggttcactgttaggtaaagcactgccctctgggagagcccagcactgggaccagattcttatgtcctcca

SEQ ID NO: 1734 - DNA, 657 bp, Homo sapiens
agataacattaagaaaatattatttgcaaaactgtgagtttgctaaagctaggagatgttgaattttatcaaatatagctgctagaattttttcagaatttttttcaccttcggttttattatagtgatggatttatcaacagatttttcattttctgaaatcttgcattcttgggataaaaatatcttggttattgtggatgtttaatatatgactagaattgatttgctcttaatcttactcgtgattacatttaggacccccccccaccccaccaccacccccaggatactctgtcttaaggtccttagctttaatcacatctgcaaagtttcctttgctgtataaagtaacagtcacgggttctagaaatcaggacctgtctatctttgggggccaaccatttaacctagcacagatagatgccttaggaccttagggcttaattctcttctggacccagttgagaaaagctgtctaggcaaacatgctcattatagctacagatggcacaaaaccatgccatgtgactgaatcaagacccggtatggtcctggctgactctgaatgacaaaactctacaaagcataattcaaaagcgtgtgacttggttgcattctgtgtggaatggaaggattcaagatgtcagctggcaa

SEQ ID NO: 1735 - DNA, 553 bp, Homo sapiens
acaaagcataattcaaaagcgtgtgacttggttgcattctgtgtggaatggaaggattcaagatgtcagctggcaattccaggaaaaactgtgattaggcttttcttagaagtggcatctgaagagcaaatggagaggcctgttcttccaggtctggttggaccctacagggagcaggccttgactctgtgagtgagcctggcttgccttccacatggcaatgcccacttagagaggaatcaggattgatggtgaagccagtatgctacacaggatagacgcagaggagtgttacaggcttcttcacgatgggcagatcaggcctcaagtggtcagagctttccaaaggtgggtgtgcacagtggagaatttcctctctgtagagagagctctgagtctggatgaccatctggaagggatatgtaggagaagaaggtggtgggtactgacttagatgattacttaaggttcctgtcaaactttgagaccccattcaactacttcaaattttagttggggaaaccaagtcccagagagagaggtcactggattt

SEQ ID NO: 1736 - DNA, 695 bp, Homo sapiens
gtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgagtttttgtggtgtcttttttgggcagtagcttttctgatttaacgtttcctgagcccattaatc

SEQ ID NO: 1737 - DNA, 628 bp, Homo sapiens
ccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatt

SEQ ID NO: 1738 - DNA, 552 bp, Homo sapiens
caacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcat

SEQ ID NO: 1739 - DNA, 534 bp, Homo sapiens
cgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaa

SEQ ID NO: 1740 - DNA, 524 bp, Homo sapiens
cttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgca

SEQ ID NO: 1741 - DNA, 532 bp, Homo sapiens
ttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactc

SEQ ID NO: 1742 - DNA, 317 bp, Homo sapiens
ccacatgattctacttctctggctctgccctgccctatcccattccgtcataatcccatccttggcctcttttctctgggtctccacagcctacaagagacatacgaggccaagaggaaggagttcctaagtgagctgcagaggaaggaggaagagatgaggcagatgtttgtcaacaaagtgaaggagacagagctggagctgaaggagaaggaaagggaggtatgtgccaggctgggggctgggatggggaagctgagggagggaaggcctggctgagggtagaggtgggggtgccttcctggcccaggctcaag

SEQ ID NO: 1743 - DNA, 472 bp, Homo sapiens
ggggctgggatggggaagctgagggagggaaggcctggctgagggtagaggtgggggtgccttcctggcccaggctcaagccctcctcttgctccccgcatcttctgccccctttctgatgccagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaagtaggtggcaggctgcgcctgcgctggctcctcttgctcctgtgggctcttgctttcgttcttgtccctcacctcccttctcgctctcctgctcgccctctcttacccctttcctgtttggttttccctcatcttcagtggctctccccccagctt

SEQ ID NO: 1744 - DNA, 396 bp, Homo sapiens
ctgccctgctgcctgtagtaccctgtgctgtttcctcctcatgcccacctgcgtgcctaccctgactctggagtgtgcccgcctgcatgcctgcctgataccccaccggccctctgctttcagtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcaggtgacagcctgagccagagtgagcctgtcttcacagctgtggccagacacaccaccctggcatctgttccctgagggaccccacatcctcttacccctcgtgcc

SEQ ID NO: 1745 - DNA, 1218 bp, Homo sapiens
ggaggcatagttaagtaacttgcctagctaaggttaaaaagctagcaggattccaccaggaaggtttgccatagatccagctaccctaaccactgctctgctctatttcttgtagataactttaatacagcatgggaaacagcaacatagagagaggagcaaagtgaaaacattgtcaggaaggtccagcgggaagtcagtccaccttggggacaagctacagtttgcctgggagagtgaggaggggaaagccaaatcagggtgacaaggtcaaacagcagagagggggctcctcttaagccaggtgtgctaagtcgaacgtggtctttaggcacctccagtcagcacaagtttctgagtaggagaaacaggtcaggttgcttctcagcatactggggtgaggggtgtgtgtggagggtggaccaacctgggatgaggccagtggggggtagggggcaaaccttgccacattcccagaaagagcagagagaaaggcagagggaagagaaagaaacggggtttcagaggatttgggagctgcttttgtatagattgtcagtgagaaggatacagaacctcctgaggcctccgaccctggcgtaagtgttaattttctgaacgttttgagcagtgacattagcggagagaacgtgcacgcactgggagtggtcatcctctttgcacaatggtggaaccattaagacgttgtcccaagcccttgggacaggcagggtgatggacacttgcaatctgacgccttgaccgtcgagctccgcttttctattgcaggaatcccagcctaaactgcgcatcctgctcgttggttgcacaaggagccgaaggctggtcccttgcccgggaaggccgcctggccggacgcgcgggtcccgccggggttcccgccttagctccggccggagcatcaggtggggcccaagacacccgcagactaggctgccgcggcctctcccggatccgacgggtctcccgcagcttgtccacactctggttggtggtcccagcacatttgcaggctccagcgggtggagacggcttggtgggggagatctctagggcgcacgccgtgccccacttcccccttacgggaaaggctttccagcgcgcggacccaggagactctcacctaggctcggccccaggctccaggggacacgcagaggcccgccgggcaccagccccgagccccccgacactgcc

SEQ ID NO: 1746 - DNA, 422 bp, Homo sapiens
ggggcatcgggctccctctggggaaacttggcctggagttggtgctcgggtgtactcagggtgtgtctgagatttgttgagaattcagacatcgggtggggctgcttcactgttttaactcagatttagcgcccaccccgcagcttgacctttcttccccagtgggctcatgtcttgctttatttctctcttggcagaatgcagagccagagccccggagcctctccctgggcggccatgtgggtttcgacagcctccccgaccagctggtcagcaagtcggtcactcagggcttcagcttcaacatcctctgtgtgggtgagtgtcagggcctggcctcagacagagggtgggtgagaacctcctgggagagggggtgcttctggccccctgttgagctgcaagggggcttcccaggcaga

SEQ ID NO: 1747 - DNA, 508 bp, Homo sapiens
agttcctggggaatgggggtgatgagggatggggtgggcggcctgcccctttctcttatccaggggccatggatgcctgagccctgcctggcctagccaccagtcaaggacagcccatttccagcctatgacacccacttcttcccctcctgtcctcactgcccaggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcaagaggcgggaagggcggccccacccagcctcctcccaccccacctacattggcccctataacagtagcccagccctcacactgcagggggccagggagggcctcttggggaatatctgaggctctgtggtcaccaacagacca

SEQ ID NO: 1748 - DNA, 451 bp, Homo sapiens
atctcaggcagaagctgttcccagaaagaaaaggccagggggcagcctggcttggccccgagccctgagccccccaagccccaagcccctgatctcagctggcagcctcctgggtgatggagctgtctgtagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtatccctgtccccacctgctgtcacaggctccatagtcttctgctgcgatgcgatgtggtggctgcctcatgcctgaacaccatggtcctcagggacctggtcgggggcttgtgggtggccccccattggc

SEQ ID NO: 1749 - DNA, 468 bp, Homo sapiens
tctctctggcctccttccccctgcccagggatatggcctgggcatgtctatccatatcctgggcatggcatgggaaccaccgctcaaaagagccaaccagcctgctgtcccctcccctgatcctggcaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgtgagcgttgggtgagggcctcagggccctggggccagagggcgaggagccggcacagatctgacacagccccaggagactcttgttccccaggattccagccttagcttctccaggacagaagggtgggcatctggagctggccagtcctacatctgtgggcaggggacaggaaga

SEQ ID NO: 1750 - DNA, 399 bp, Homo sapiens
ggagttctgggacatttctccagaagagagccaggaagtaagcatctggccctggagcctttgttcaggtctggctgcccctccctaggacccaggggcagggagggagagtctgccattagtctgtgtcagctcagggcttacgcatacccgggcccctttccaggcacatctgccctttgccgtggtgggcagcaccgaggaggtgaaggtggggaacaagctggtccgagcacggcagtacccctggggagtggtgcagggtgagtgtggacaggaaatgcatcctgggggtagaactgagttccctggcctgccctgctgcctgtagtaccctgtgctgtttcctcctcatgcccacctgcgtgcctaccctgactctggagtgtgcccgcctgc

SEQ ID NO: 1751 - DNA, 700 bp, Homo sapiens
cgaggtaaacaaagtagggggcaatgatgctgcccactctggaggccgtggatgtgacccccaccgccatgttcctgaccagggttgggtagagctcagcagtgaagacatacagcatggagaaagcagaggtgatcccaaattttcccagcatgaccagaccaatggataagaagtaataatctggaaaagagacccggtataaacaatggtgcttttagaaatgatactttcttatatcagttatttttattgtcctttttgcttcagtgggagtacttttattaacataaatatattcccaaaatagcattttctcttcaaatgtcctaatatttgggcatggacaaagatggagctcatgtgaggggtggctttgtactttgttctactgttattctaggtcattaatgcattcagtgacctttgtccacttgtcttttgtttgttaaaacagtttcatgggtaagctattagcatgttaatatagttaagttttatcttcaaagaggaggaccaatcctttctatcctctttcttattattaagaaatatgtatttctattactatcaataatttagtgacattttaatattatgagaacgtcagacacaaggggaaaagggaagcatatatccttttgtgtgctatttaactacttaaagattcagaccagaaaaccactgaatgtatcctgga

SEQ ID NO: 1752 - DNA, 700 bp, Homo sapiens
  misc_feature (1)...(700): n = A,T,C or G
tcttcaaagaggaggaccaatcctttctatcctctttcttattattaagaaatatgtatttctattactatcaataatttagtgacattttaatattatgagaacgtcagacacaaggggaaaagggaagcatatatccttttgtgtgctatttaactacttaaagattcagaccagaaaaccactgaatgtatcctggaaccgacatgtcctactcactgtaatacttgaatatacacccagggaaaatgtttgagagtagccagaaattaggaatcatgactatgagttaaagggagatgttaggtgagtctttctgtgaaggggatgactgggagagttactcttcctctttggtgctttctgcttctctgagactgtctcttctgtttggggtagttgttttgaacacaggaaacaacatacgtagtgagcaatcacctgtctaattgacttatgaatggcttatgatgtaaaggctgaataaacatggagcagtgactcagaagcagcctagtcaatatgtgggtcttttctggtaagctgttcatcttggttaacttnntacccacaggtaccagttgaatgaagagaagcacacctcctccccagaacagtactgcagctatgatataacgcctgggcagggttcgcaatagcagccaggctgtaatgtaagctggaatttcaatcaaggcag

SEQ ID NO: 1753 - DNA, 700 bp, Homo sapiens
  misc_feature (1)...(700): n = A,T,C or G
actcagaagcagcctagtcaatatgtgggtcttttctggtaagctgttcatcttggttaacttnntacccacaggtaccagttgaatgaagagaagcacacctcctccccagaacagtactgcagctatgatataacgcctgggcagggttcgcaatagcagccaggctgtaatgtaagctggaatttcaatcaaggcagagaggaaacagttcaggtaggcatctccatgtaaattaggagcatccagagacagagcaaagtaacccactgaggtcagcatcctgaaagaagaaggtaaaaatgacaaagggatggtgtgaatcgccctaaaattttatgatggtcaagaaattctctatatcttgctgtcttatnnatagccactaccctcattggctacttaaatttgaataaattaaaattaaataagattacaaattcagttccttagttacactagccacacttcaagtgctcaatagccacgtgtanttagtggctactatattgaacaacatagatatgaaacatttccgtcactgcagaaagttctatnggacagtgctagtctagatataccaatattcaacaataacttttctcagctagttgatttcaagttttcctatttcctgaatagtttgtacctcctcaatctcttagagctattatatgaagaaaaaatattagtcacatca

SEQ ID NO: 1754 - DNA, 700 bp, Homo sapiens
  misc_feature (1)...(700): n = A,T,C or G
gctactatattgaacaacatagatatgaaacatttccgtcactgcagaaagttctatnggacagtgctagtctagatataccaatattcaacaataacttttctcagctagttgatttcaagttttcctatttcctgaatagtttgtacctcctcaatctcttagagctattatatgaagaaaaaatattagtcacatcagtgaacataaaatccagatttcattctttaacaaaaaagagatacaagggtcatactgtgggattcacttagaataaattctgattnnntttagggaaaagagtgaatgtcccctaatccttcaaagtatnacagnctgcagtntgtatattnngtcattatagttaacttccatgtagaagcttctctgtgggccatgcgtggtgnctcatgcctgaaatcccagcactttgggagaccgaggcaggcaaatcacctgaggtcaggagtttgagaccagcctggccaacatggtgaaaccccgtctctacttaaaagacaaaaattagccaggcatggtggtggcatgtgcctataatcccagctacttgggaggctgagacaggagaattgcttgaacccaggaggcgaaggttgcagtgagctgagatcgcaccattgcactccaggctgggtgacagagcgaaactctatctcaaaaaaataaaaacataaataaa

SEQ ID NO: 1755 - DNA, 700 bp, Homo sapiens
  misc_feature (1)...(700): n = A,T,C or G
cccgtctctacttaaaagacaaaaattagccaggcatggtggtggcatgtgcctataatcccagctacttgggaggctgagacaggagaattgcttgaacccaggaggcgaaggttgcagtgagctgagatcgcaccattgcactccaggctgggtgacagagcgaaactctatctcaaaaaaataaaaacataaataaaaaaaagaagcttctctgtggaaaaataactatgtaactgagtacccccatttttctaagagatagtttattttctctctctcttcttttctctttcctccttttctgcactttctacttagctctttagaagtgcaattatagccttttaacctcctcttcactggacactccctgcagggcaaattcatctaactatgtgcttagaagctccagagtggaactctcaccgcccagatttcctcaagcgatatcagtcaatttccaactcaaagtatgcctgctagagtttttggccacctatacaacctgtttctgcccatgaaggcaccacntcaactgcccagtagataaggcagcaagctagccntctgatccctcacctgctcgcgtcctcccctgccttttagaagtgcctgctttccgcttcaaaaagaggagcggtggtacccttcaggcaggaagccgatacctttctccctaagctagctttggaataaa

SEQ ID NO: 1756 - DNA, 700 bp, Homo sapiens
  misc_feature (1)...(700): n = A,T,C or G
tatacaacctgtttctgcccatgaaggcaccacntcaactgcccagtagataaggcagcaagctagccntctgatccctcacctgctcgcgtcctcccctgccttttagaagtgcctgctttccgcttcaaaaagaggagcggtggtacccttcaggcaggaagccgatacctttctccctaagctagctttggaataaaaagtcactttccttacatcagactttgctcttgttaattggacgctgcaagctgtgagtgactgaacctgagtttttgttacaactgcactatgcagacacccctgtgtagaaatttgcttattattaacatgactgagaagcagaggatatctgaaaaatgacttcaggaacactagtggatctttttacacatactagacccaaattagataatacaaggactaattcataaacacaacaaataagtatgctcaagggatcttagtgattttcccatttagtaataggagtagtttagatagaactagtgactaattttttattagcttagtagcaccactacccaagaacatttgcatcagggatataggctgaaatgtaagaactaagaagcccatgtacctaggacacacttgcttaattcagacgcataagctctgtcattgatctcttctaattgccaagtaggatggcccttaaaaataaacttagattagc

SEQ ID NO: 1757 - DNA, 700 bp, Homo sapiens
  misc_feature (1)...(700): n = A,T,C or G
atagaactagtgactaattttttattagcttagtagcaccactacccaagaacatttgcatcagggatataggctgaaatgtaagaactaagaagcccatgtacctaggacacacttgcttaattcagacgcataagctctgtcattgatctcttctaattgccaagtaggatggcccttaaaaataaacttagattagctgcagcctaaatctaccagttctgacgatcatcgtgtgtgtgtgtgtgtgtgtgtgtgtgtgtgtgtgtgctgccatcatagagtaggaattttcttttttccttttttcttggcagataaattattaaatctaatctataaagccaattcagtatttctgcgcctgaaagccacttgttagtttgctattggcacgtgtaaaaagctgatcaaggctccaatccaggcaatggggatctaggttattctagcctcagtgttcaattgccaggtcagcttcaggaagcaggagctgaattagcatntctgcctcaggcaacacggacatcattagtcttaatctcataatttttggtggggagggaaccattacccagggacatcaatgatctcaatcccataactttaggagggggaagggaatgctttccctttgggtcccagtactgcagacttaaatactgtaccctgtgacttttttttttttagatggagtctt

SEQ ID NO: 1758 - DNA, 700 bp, Homo sapiens
  misc_feature (1)...(700): n = A,T,C or G
agcatntctgcctcaggcaacacggacatcattagtcttaatctcataatttttggtggggagggaaccattacccagggacatcaatgatctcaatcccataactttaggagggggaagggaatgctttccctttgggtcccagtactgcagacttaaatactgtaccctgtgacttttttttttttagatggagtcttgctctgctgcccaggctggagtacagtagtgcgatcaaggctcactggaacctccacctcctgggttcaagtgattctcctgcctcagcctcccaagtagctgggattacaggtatgtgccaccatgacccaggtaatttttgtatttttagtagagacggggtttcaccatgttggctagattcgtctcgaactcctgacctcaggtgatctgcccaccttggcctcccaaagtgctggaattacaggcgtaagccattgcgcccagtgacatttttcaatatctagtcccatgaactgaatagaggcatttcaaaataatttagaattttataatcttaatttttcctcaggaaaacccagtcgttgtcataatgttcctctgagttaagaaaatcagttgcatacttatgtgctggatatctgcatttccaggtcacttattacttaccatagcagcaaagacataatggtcattatggcaatattccgagtcctga

SEQ ID NO: 1759 - DNA, 700 bp, Homo sapiens
aatagaggcatttcaaaataatttagaattttataatcttaatttttcctcaggaaaacccagtcgttgtcataatgttcctctgagttaagaaaatcagttgcatacttatgtgctggatatctgcatttccaggtcacttattacttaccatagcagcaaagacataatggtcattatggcaatattccgagtcctgaacaggtccagaatgaaagctttctgctgcttcaggggatttagctcctgtaaccaaaataatgcaaataaccatgagattaagaggtagtaaggaagtatctttggctatgatgcatggggaaaacttatgcatgcaactcccacttcaccttgactatgcttagaagtctggtgattggaggcaatagggcatctacatatatgacacttactctgacactttaaaatgtttgtagtccattttacacagaagccttttaaatatataacacccccttccctgtctcgttagacaaagcctgttggctaacatagcctttctctgactgacagtcagagaatggatgtcatttaccacactgatctgtgatcctcaggactgcctattgaagggtagggccatgtagtcccttccttgaggccacgtctgctttttacacttctctgtttatttgtttgttttttttagatggagtctagctctgtggcccaggctgga

SEQ ID NO: 1760 - DNA, 700 bp, Homo sapiens
ctgttggctaacatagcctttctctgactgacagtcagagaatggatgtcatttaccacactgatctgtgatcctcaggactgcctattgaagggtagggccatgtagtcccttccttgaggccacgtctgctttttacacttctctgtttatttgtttgttttttttagatggagtctagctctgtggcccaggctggagtgcagtggtgtgatctcagctcactgcaacctccacctcccaggttcaagcgattctcctgcctctcagcctcctgagtagctgggattacaggcgagcaccaccgcatctggctaatttttgcattttttgtagagactgggtttcaccatgttggccaggttggtctcaaactcctggcctcaagcagtctgcccactttggcctcccaaagtgctgggattacccagccttgctttttacacttctcttgttgtagtcatttagcatcagaacagacttcagtttactggcgggccttgggcaagtaacgatcctctctgaacttcagcttactgctatataaaatgggtatattaattgggagttgagagattaaatgagatcatatatatatagcttagcacagtgcttgaaccatggtaaatgtccagtaaatttaaactattattattattactgtatcattgaggaaaagaggctagccatcagcggtcag

SEQ ID NO: 1761 - DNA, 700 bp, Homo sapiens
  misc_feature (1)...(700): n = A,T,C or G
ttgggcaagtaacgatcctctctgaacttcagcttactgctatataaaatgggtatattaattgggagttgagagattaaatgagatcatatatatatagcttagcacagtgcttgaaccatggtaaatgtccagtaaatttaaactattattattattactgtatcattgaggaaaagaggctagccatcagcggtcagtgacaaatccttactgctatcaatgggtttatactcttttacttttatttatatttattttcttgtttgttttttgagagggagtttcantcttgttgcccaggctggagtacagtggcgcgatctcagctcactgcaacntccgcctcccaggttcaagcaattcccctgcctcagcctcctgagtagctgggattacaggcacctgccaccacacctggctaatttttgtatttttagtagagatggggtttcgccatattggccaggctggtctcaaactcctgacttcaggtgatccatccacctcagcttcccaaagtgctgggattacaggtgtgagccactgcgcccggcctattcttttgcttttaatttgctgatattaacttgctatgagttatgaatcaaggtaaccaagctgattagaattgaaactaacataaaagttattaggctctgaggtggggaatctctcagggatgaagtaccaggacttt

SEQ ID NO: 1762 - DNA, 700 bp, Homo sapiens
catccacctcagcttcccaaagtgctgggattacaggtgtgagccactgcgcccggcctattcttttgcttttaatttgctgatattaacttgctatgagttatgaatcaaggtaaccaagctgattagaattgaaactaacataaaagttattaggctctgaggtggggaatctctcagggatgaagtaccaggactttgtgactttgtggccctacagtgcatgcgcagtaagagactgatggaggagtttttattatgaagaagtgggagtgccaggcctgccttcacagcaggtcctctccaaatgtgagtgtccttttttctaggaatgatcagacacttacacagctcacagccacattgccttttctctcttgcactatttggattgtagagccccagaacatgcccccagcagaataaccctggtattataacaaagcaaagccactgcataaactagtgggaaccagacatcttcttggagggttccaagggtggtgcacacagacaggacctgtggaccagtcctgtgctaatacttggtggttccacggggcccttcttaaatgcaggttgccaggttcctccctgggcttgcctacttcgactcttttaaacagaggcctgagaatctgtattcttaaagcacttgggtgattgtgatgagcagccaggattggaaacctcagaacaa

SEQ ID NO: 1763 - DNA, 700 bp, Homo sapiens
gtggtgcacacagacaggacctgtggaccagtcctgtgctaatacttggtggttccacggggcccttcttaaatgcaggttgccaggttcctccctgggcttgcctacttcgactcttttaaacagaggcctgagaatctgtattcttaaagcacttgggtgattgtgatgagcagccaggattggaaacctcagaacaagaatatgcttgtatccagtggttgtccctggcctgggtggagccaccaaaatgtctttggatcaggtaccagaagcaggttgaaggtgcttcttctgaagccaaggatgcttgagattgctttctaagacaatactctactctatatcttttcctatccaagttaatgctactgcctgtaacatgaagtgaaaaatcacagttgttaagagcatgtactttggtgcctgggagaactaggtcacaaatcccagtttaacatctgtgtgatcctgggcaagttacttaacttcgctgtgccttagtttctttttttgaaaaaaaaaaaaagcatgagcaatgagcagaacacagtgcctggcatttggtaggctcttcaatatcattctaaatagggtgcatttgctggcacagggctctgcagatcctcctaaagaggatcctacgggaggtgagcaggggagatgaccaggcctcaggaaagcgcaagccccctttccc

SEQ ID NO: 1764 - DNA, 700 bp, Homo sapiens
ttagtttctttttttgaaaaaaaaaaaaagcatgagcaatgagcagaacacagtgcctggcatttggtaggctcttcaatatcattctaaatagggtgcatttgctggcacagggctctgcagatcctcctaaagaggatcctacgggaggtgagcaggggagatgaccaggcctcaggaaagcgcaagccccctttcccttaatgggtttgtccagttcaggctagatgtgcatcatggcaggaagaaagaaggcactgtcaggctgagaatgatggctcacatctgtaatcctagcattatgggaggctgaggtaggaggattgcttgagcccaggagtttgagaccagcctgggcaacatagtgaaaccctgtctctacaaaaaaaaatacaaaatgttagctgggtttggtggcaagtgcctgtagtcccagcttgggaggttgaggtgggaggattgcttgagcccagaaggtcgaggtcgaggctacattgagctgtaattgtaccactgcactctagcctgagcaaaacagtgagactcaaaatttttttaaagtgtgtgtgtgtatatatatatatatatatatatatatatacacatacacacatatatatacacatttatatatgcgtgtgtgtgtgtgtgtgtgtgtgtgtgtgtatatatatatatataaaggcactgccagaaccat

SEQ ID NO: 1765 - DNA, 700 bp, Homo sapiens
tgtaattgtaccactgcactctagcctgagcaaaacagtgagactcaaaatttttttaaagtgtgtgtgtgtatatatatatatatatatatatatatatacacatacacacatatatatacacatttatatatgcgtgtgtgtgtgtgtgtgtgtgtgtgtgtgtatatatatatatataaaggcactgccagaaccatgtgttttaacactgaactatattcttatttgtccataactatatatctcatatctattttatgattgctgtcatccacataggtagatccctacaactagactctaagtttcacagataggaatcaggccacctagctgataaataccgataaacaccccagcacagccctgaagggcagaagtgttagacactcccaatgttgttgttgttgttgttgttgttgttttatccatttaaattgactgagacttgaaatggacttcttgatttgaagggcaaaggattaagggatgttttgtcctggcagccctctgagagcttgagttcatggccagtctaagcctctagccatagccagagtatctgcttctggaaaaggtcctgaaggccagggactggggaagccgtgggggtgagcagtggcatgcccaccgtcctctacagagttctgctttctgtactacatgctttggtgcagggcatgtataatgttactga

SEQ ID NO: 1766 - DNA, 700 bp, Homo sapiens
tcctggcagccctctgagagcttgagttcatggccagtctaagcctctagccatagccagagtatctgcttctggaaaaggtcctgaaggccagggactggggaagccgtgggggtgagcagtggcatgcccaccgtcctctacagagttctgctttctgtactacatgctttggtgcagggcatgtataatgttactgaagccaccacagtcttttttaggtgtcctgagcagactcctacctatctcctagacaggaatgccctgccccatcctctccactcatttaagtgagtcctgctgtcctccctggcttggacctgcctccagccatgggccaccctgctatctttctctgtattgctggcacacagtgtctctacttggatacttaccatttcctcccttatgccattctttatctttttatctaatcctcttgccaatcttagttacattctatgttcctttagaatttgggctgtgtcttttcttatttcctctaggagccagcacagggcatggcacactgcatatcctcacgaactgtcaggaggtgtggctgcttccacagaatatcagcttttccttgtggccaccagctttcaagggtgaatcctcaagcctgtgctttcaggccttaaggttctagacatgacacagagtgagactaaagacatgcatagcttcctcagcagtc

SEQ ID NO: 1767 - DNA, 700 bp, Homo sapiens
ctctaggagccagcacagggcatggcacactgcatatcctcacgaactgtcaggaggtgtggctgcttccacagaatatcagcttttccttgtggccaccagctttcaagggtgaatcctcaagcctgtgctttcaggccttaaggttctagacatgacacagagtgagactaaagacatgcatagcttcctcagcagtctgtggtaagattcagggtacagtggagaacccagggtggactagccctgaaacatatttttccacttaatctggacatttaaaaatcatcagtacatagctgtgtcagtggtttggagcaatgccaatagaaagttgatgataaacttgcaaaataaagcaaactaatatttaatgaacgcttgctatttgctaagcagtttacatatattattgcatttaattcttataaacagccctttaaggtggattttatcttagaatttaatcatgattgtgttcctaaggcctagtgcaatgcctggtacatagtgggcacttaacaaatattgaattaagttaaattccataaaatcaagaatgcatagctgatctcaagaggaaacatctgcaaatgcttacctccacagaatcaaatatcactgctggtacagctatgttgttcatttttgcagctttttggatgatatcttcagcctctctaaatcttctctgggatat

SEQ ID NO: 1768 - DNA, 700 bp, Homo sapiens
ctggtacatagtgggcacttaacaaatattgaattaagttaaattccataaaatcaagaatgcatagctgatctcaagaggaaacatctgcaaatgcttacctccacagaatcaaatatcactgctggtacagctatgttgttcatttttgcagctttttggatgatatcttcagcctctctaaatcttctctgggatatcagccatcggggagattcaggaatgaacctataatttatttttaatatttaataatttttcacaacagcagggctggatactattaaatctgagtttcccccaaatagttttaattttgtaaaattctagtttgtctttttaaagggagtccacataagatttctattggagcataggaataaataaaaccaccttcaagtttcaaacttctgatcaaattataagaccgatcatcagttgtgcttgagaccaggaccagaccataaggggtgacattaactatgggcatgtttgagccagggctctggagaagttcatccaaaacttataggtagtgtggctcataaaagaaacatagctactagactataagttcccctagagaagagactgtctttgcagtgggtccatcctaaggagaattgctggtgtcccagctggtgatgttcacagtttattgggaaaaggatggccagggcacctgtgttcttgatcgttt

SEQ ID NO: 1769 - DNA, 700 bp, Homo sapiens
gggctctggagaagttcatccaaaacttataggtagtgtggctcataaaagaaacatagctactagactataagttcccctagagaagagactgtctttgcagtgggtccatcctaaggagaattgctggtgtcccagctggtgatgttcacagtttattgggaaaaggatggccagggcacctgtgttcttgatcgtttcctttagtcaaaagagaaagtgagggcactgacacccgcctgtgtggggcccccatggctttcaacagattcccagatcagcgagtgcccaaaccagcttttgggagatgagccccaatgttgtctttttgttaatgtctaaaaaagcttattgttttaaattacatagtctattcccatttatagctgatgctcaaacacagttgcaaataatagggcttctattctttctaaatttttatttctcaaaatcttttagccattctcctgtcagctctcattttccttacctattgtcagtacagatggtccctaacttatgatggttcgacttatgatttttctactataggagaaaaatgatatgcattgagtagaaaccttactttgagtgctcatacatacagccattctgttgttcactttcagtacagtatttaataaattacatgaaatattcaacacttaattataaaataggttttgtgttagaaaatttt

SEQ ID NO: 1770 - DNA, 700 bp, Homo sapiens
tacagatggtccctaacttatgatggttcgacttatgatttttctactataggagaaaaatgatatgcattgagtagaaaccttactttgagtgctcatacatacagccattctgttgttcactttcagtacagtatttaataaattacatgaaatattcaacacttaattataaaataggttttgtgttagaaaattttgcccaattgtaggctaatgtaagtgttctgagcatgtttaaggtaggtcaggctgagctatgatatttggtagggatgcagggcaggcaagctccagagtggggtttggcccatgagggttcttggctttgcccaggaaagaattcaagggcaaactggaggtggaagaaaacagctttattgaagaggcaatgttacagctccgtgactgctcctgcagagcagggctgccccacaggcagagagtagcagctcaggacagttttgcactcatatttataactacttttaattacatgtagatgaaaggtcagtttatgcagaaatttctagggaaagggtagtaatttttgggtcattgggtcattgccatggaaaggggcaataaagcctgagtgttgtcatggcaacagtaaactgacatggcacacgggtgggcgtgtcttatggaaagcgtcttctgccctggctgtgttttagctggtcctcaatttggtcca

SEQ ID NO: 1771 - DNA, 700 bp, Homo sapiens
agatgaaaggtcagtttatgcagaaatttctagggaaagggtagtaatttttgggtcattgggtcattgccatggaaaggggcaataaagcctgagtgttgtcatggcaacagtaaactgacatggcacacgggtgggcgtgtcttatggaaagcgtcttctgccctggctgtgttttagctggtcctcaatttggtccagtgtccaagccctgcctctggagtcgtgtctggcctcctacctcagtaggttaggtgtattgacctagaatattctcaatttacaatgggcttattgggatgtaaccccattataagtcaaagagcatctgtacttacttagcctagacaacaaattataagtagcagacacagagtcctgtgtagttaattggccccaaacccacactaggaattagctcagagcaaaacaaatgaccaaccagcaggtcccctctccagcttaatagcacatgagttgaaaaatgagcctagtttgcatttttcagaatatgcctttagtgggtccctataggaactacaataatgttaggtcactgactctcagtaattagaactgtgctgtccgatagaaacttctgaaatgttctgtatctgtactaagacagcacccactaaccacatgtagctattgagctagtgtgattgaagaaatgaaaattcaattttatttactttta

SEQ ID NO: 1772 - DNA, 700 bp, Homo sapiens
tttttcagaatatgcctttagtgggtccctataggaactacaataatgttaggtcactgactctcagtaattagaactgtgctgtccgatagaaacttctgaaatgttctgtatctgtactaagacagcacccactaaccacatgtagctattgagctagtgtgattgaagaaatgaaaattcaattttatttacttttaattaattttaacttaaatagctgcatgtggctggtggctactatattagtgcagaattagagatcttactacacagccacgatatacctcatggatggggccagtatctttctccaaccagattatgcttagaaatatcctacctttttttctacagaccactggcctcagattcttaatgtttaatcagctagaaattgcatagctttcctcacattgcatctatggcctgcttccctaccccatccccaccgcctatacacatactccattcacacctgtggccacttactgccaagccttttaaaggaaacttgggacataaaaagtcccccaaaccaccagcagtgcctctatgtaggtttacctcccatttctagcccactgtactcagggccactggtatctctagttttgaattgctttgatttttttttggtgcacataatctcaaatctagctgatcatttcaaaagtcaatggagtgccaaatgaggtag

SEQ ID NO: 1773 - DNA, 700 bp, Homo sapiens
cttttaaaggaaacttgggacataaaaagtcccccaaaccaccagcagtgcctctatgtaggtttacctcccatttctagcccactgtactcagggccactggtatctctagttttgaattgctttgatttttttttggtgcacataatctcaaatctagctgatcatttcaaaagtcaatggagtgccaaatgaggtagcacactataatctctctgtagattgaattcagactaaacagcagtgaggtgttgctggagagcttgtctcatactgagcaggcggcagggtccatgtcagctctaagcatccctccataccccaaccactagactgatgagcatccctttgggaagacccacctgcaaggatgggatgttcagaagaaagctattttcttttataggaaaatggtaagaccactggtaaatgttcagggggagcactcagcttgtcagtgctggtcccaggctggcctctgtctggggcaagtcctgtccctggtacagtatgcccacagccaggagcattcatggaccagctcctggggaatagaagaaaaagctctccttagggcacagtgagcaggctccctgtgggatggaccttctctgctggaaactctggaggctgactctggagggctaatggatcagagctgttcgttcctcgctgtgacatatggtcccgaggcaaagat

SEQ ID NO: 1774 - DNA, 700 bp, Homo sapiens
ctggtacagtatgcccacagccaggagcattcatggaccagctcctggggaatagaagaaaaagctctccttagggcacagtgagcaggctccctgtgggatggaccttctctgctggaaactctggaggctgactctggagggctaatggatcagagctgttcgttcctcgctgtgacatatggtcccgaggcaaagatcccatccctactaatctctgtacagcccatcagaggctttatattgttattctctctctctctttctctctgatagaatcataccttaatcagattgattataactttttttttgagacagcatctcattctatctgggctggagtgcagtggcatgatcatatagcgcactgtaatcttgaactcccaggctcaagggaccctcccacctctgcctcctaagtagctgggactacaggcgctcaccactgcacccagctaattttttatttttagtacagacagggttttgccatgttgcccaggctggttttgaactgctgggctaaagtgatcctcccaccttggcctcccaaagtgctgggattacaggtgtgaatcaccatacctggctaattataacattttgaaagtactggtctcttaggtcaaaatgacaactagagccagagaacatagtttattaaaaccattcagctgaagaggcagaaaagaacctt

SEQ ID NO: 1775 - DNA, 700 bp, Homo sapiens
cccaggctggttttgaactgctgggctaaagtgatcctcccaccttggcctcccaaagtgctgggattacaggtgtgaatcaccatacctggctaattataacattttgaaagtactggtctcttaggtcaaaatgacaactagagccagagaacatagtttattaaaaccattcagctgaagaggcagaaaagaacctttgaataatcttgtcatgtgtcttgagagaaccttagtcactaacatcttttccaataaattcagctagcaagggagttgtggagagaaggacagatgatgatgatgataattactctcattcagaaaattgctctgctcttgtaagtctgggatgctttccttggaggcacagctatgtagataatggccagcccttattcactgctcctcaggccgggtttcccggtcctcagacagggttccagaggaatgttgcaaatcagaataatacataacctttaacaaactgtcaactccccctgcacacttcatgccaataatttacactagtaaatcacagcactcttacaggtcatgagaatacaggggcttagagtgagcccacctgacctgcgctatctcgtcagacaggtggcctgcctgtcaacctctatgactgcctaacagctgcagtaagataaaggcctagacagcttcccagtcaggaggtatccaaagg

SEQ ID NO: 1776 - DNA, 700 bp, Homo sapiens
ctgcacacttcatgccaataatttacactagtaaatcacagcactcttacaggtcatgagaatacaggggcttagagtgagcccacctgacctgcgctatctcgtcagacaggtggcctgcctgtcaacctctatgactgcctaacagctgcagtaagataaaggcctagacagcttcccagtcaggaggtatccaaaggacagggcaaccatgaggtctagtctaaattgtgagttccaaaaaatggtcaaagaagcttgtgttatgtgtaagcaggtagaagttatgcagttcggtgaaaccagtcagtgctggaagatttgactttgatataatgaaatcaaacaaagaagaattaatgagagagaaagagaatgagagagagacagaaccagacccaccaatggaaggaatctccttttctcttgcttaaatatgaaaaagcaaaggaacaggaaatctccaaaaagagggtatgtctgacaccttgttctatgatttttaatttattctttcacctgaaatcccccagatagtcatattgggcaagactgaggccagaatcttcaaactttgttattcctataactgttgtgttaaaactgagttgggaggttgtgggaggagagaagaggacatttctctaacaatttattaaataaaaagtaattttctcactcttcgagacatagcagataa

SEQ ID NO: 1777 - DNA, 700 bp, Homo sapiens
ttttaatttattctttcacctgaaatcccccagatagtcatattgggcaagactgaggccagaatcttcaaactttgttattcctataactgttgtgttaaaactgagttgggaggttgtgggaggagagaagaggacatttctctaacaatttattaaataaaaagtaattttctcactcttcgagacatagcagataaataggcacactatcatagtgctaataaataggcttccctttcatagatgctaatcgttatatgatagggaagcttgaagaattacattagttggatagagtgagatttttctagagagagaaaagtgatgaaagagcagggggcagagttaaaaacaacaaaatccaacaccaccagctccacaaataacaagtagcaacagacaggagtggctggtatcaaggaagagattggaatcctgagaatgtgctttttaggacaatggagactcaaactccagcacacaggcccacccacaatgaggcaaaaactctcccggcttggaagctggcctccgcgagttccgtggaggtcatgcaagcccaggctaggtcagcatcaggctccaggtgtgttccaggtgtgctgacccgcagcagagggcctgtctggggacgagtcacactcaccaccacagcgggacacacagcactcccggcaccgtcagcgccagcagcagc

SEQ ID NO: 1778 - DNA, 700 bp, Homo sapiens
gaggcaaaaactctcccggcttggaagctggcctccgcgagttccgtggaggtcatgcaagcccaggctaggtcagcatcaggctccaggtgtgttccaggtgtgctgacccgcagcagagggcctgtctggggacgagtcacactcaccaccacagcgggacacacagcactcccggcaccgtcagcgccagcagcagcatccgccagtctctgatgaagtaagcaaacagtggcagcagcatatagccaactgcaaaaaatgtgcacactcctaatgtagagaatataatacgaactgacttgccaagaatttctgttcctgttcaaaacaagggaggagtattagcatattaactcactttaatatttgctttttatatcattatgtggcagttagagttcaaactatcaccacttagaaaaggggaaaggcatttgcctcatggcccagagcaggcatggtcagggtagaggaaggtgggacgtgatccaagacttggcaacttatagaaggttgaatttctatgagattttaatggagccatagatttatttatttatttttaattaatttattattattattattatttttgagacaaagtctccctctgttgcccgggctgcagtgcagtggcgtgatctcagctcattgcaacctctgcctcccaagctcaagtgaccttcccacttcagcc

SEQ ID NO: 1779 - DNA, 700 bp, Homo sapiens
ggcaacttatagaaggttgaatttctatgagattttaatggagccatagatttatttatttatttttaattaatttattattattattattatttttgagacaaagtctccctctgttgcccgggctgcagtgcagtggcgtgatctcagctcattgcaacctctgcctcccaagctcaagtgaccttcccacttcagccttccgaacagctggaactacaggcgtgcaccaccacgcctggctaatttttgtatttttagtagagacagagtttcgccatgttggccaggctggtcttgaactcctgacctcaagtgatctacctgccttggcctcccaaaatgttgggattacagtcatgagccaccgcgcctggccaacttattttaaggccattccatgtcataaaaatatcatgcccagccccaagagctaatcccttctgagaatgccacatttccaaaataagagccccaacatgagaagcagagagagcatttcaggagacaagcagtggctcttctgaggggccatgtggggtcaaggtgtgtgtagcctttccaacagttctgaactgtaaataaacagacattggcccatcaggaagcagtggagagttcatcatttccaagacctcagggcacacttacccatgcctgagccctgagaaatcagttggagtgagctggctctggaggt

SEQ ID NO: 1780 - DNA, 700 bp, Homo sapiens
tcaggagacaagcagtggctcttctgaggggccatgtggggtcaaggtgtgtgtagcctttccaacagttctgaactgtaaataaacagacattggcccatcaggaagcagtggagagttcatcatttccaagacctcagggcacacttacccatgcctgagccctgagaaatcagttggagtgagctggctctggaggtacacagacaggccttcctgcagcatgctgtgcccagagatcagcccaggcagacacagtccacagtccatttggaccaaggaaagaaaagcaggcgctgttctgctgcccctgcaggcagcagccctagacctgtccacacacccattgaactcacagtgctttccctgaacagcagaaaggcccatgactgcttggtgcgggcactgctttttgggaaaggacatgcaggcgactattggcctctgctctgctcagtgccacagtgagcagagatggcaccagatgggagtccaagaacaaagctccttctcttgtcacggagctctgggccctttccacagagtctgcccttggttcactacacctggggcggagatgtgaccaatggcaatggctctgccttttgttggggatctgcccatgctatagagaagtggcctggaagatacaaaacagataattcaaaggtcattcatgcttgccttttaagagagattt

SEQ ID NO: 1781 - DNA, 700 bp, Homo sapiens
aaagctccttctcttgtcacggagctctgggccctttccacagagtctgcccttggttcactacacctggggcggagatgtgaccaatggcaatggctctgccttttgttggggatctgcccatgctatagagaagtggcctggaagatacaaaacagataattcaaaggtcattcatgcttgccttttaagagagattttctcagtcatgtttatatgccctaggcacaggctaagggattaagagctaattccagagaagcagcaaaattactatgttggctggtttctcattttaccacctatctgttcccatcccaccccactcattccccttcactgttcataactgagagatctgcctcagtgggtccctctcaagaggccatttaaaaacctggactgatagaaacagccagtactttgtgcctcctgcatcccatgttggagacaattgccctaaccacccagagcattgctcagcctataaacccatttccaaggatagggcctgacttctttgaggatcatgagtatgatttccaggtcttttctgacctcattaatgaccttcctgctatgcactggtttctaaaccccttggccgtgattgtgatgtggaaataaatagaaggtgctttattcttaagcagagattcagtggcagagggtttgattttggaaaagagaaagggcgcag

SEQ ID NO: 1782 - DNA, 700 bp, Homo sapiens
aaggatagggcctgacttctttgaggatcatgagtatgatttccaggtcttttctgacctcattaatgaccttcctgctatgcactggtttctaaaccccttggccgtgattgtgatgtggaaataaatagaaggtgctttattcttaagcagagattcagtggcagagggtttgattttggaaaagagaaagggcgcaggatcaagtgagaatcttgtagaattgtgaggccagaggagctttctcctaccttcatgaccttgttaagaaaagagaagttatactactgggttcctggataatctccctctctaagcatgggtctcagaccagaacagttatataactttgcagagtgcatgttggggacagagactttgtaggtctctctctttgccttcctgtggacagcatggatggtacaaattgaaataattcctttttagtcctactttctgctctcttttaggcagtcacccttccttaaacaggatcaccatcttcacagctagcatttttttgagtaggtactttgagacaggttccaggctaagtgtttacatatattatctctttgacccttcacaccagttatataaaaactaatattccaggccaggcacggtggcttatgcctgtaatcccagcactagggaagccaaggcaggcagatcacctgaggtcaggagtttgagacca

SEQ ID NO: 1783 - DNA, 700 bp, Homo sapiens
tcttcacagctagcatttttttgagtaggtactttgagacaggttccaggctaagtgtttacatatattatctctttgacccttcacaccagttatataaaaactaatattccaggccaggcacggtggcttatgcctgtaatcccagcactagggaagccaaggcaggcagatcacctgaggtcaggagtttgagaccagcctgaccaatatgatgaaacctgtctctactaagaatacaaaaattagccaggcatggtggcaggcacctgtaatcccacctattcgggaggctgagacaggataatcgcttgaacccaggaggcagaggttgcagtgagccgagatcatgccactgcactccagactgggcaacaagagcgaaactccatctcaaacaaaaacaaaaactaaaacaaaagctaatattcctcctactttacacataattagctgagacttcagagttaaagccaattgcttaaattcatgcacataataagtggtgcaccaggatttaagccttatttgctctatggatactggtctaccttccaagaaaaaaattactgggggcatgacttggccttataaagcagttcttcaactgagagtccagtagagacatgaggggagatgggtaaggccatatcctgctgtcatttttacagtttttcttttttttctttttttttttttt

SEQ ID NO: 1784 - DNA, 700 bp, Homo sapiens
aagtggtgcaccaggatttaagccttatttgctctatggatactggtctaccttccaagaaaaaaattactgggggcatgacttggccttataaagcagttcttcaactgagagtccagtagagacatgaggggagatgggtaaggccatatcctgctgtcatttttacagtttttcttttttttctttttttttttttttttgagacagacttgtgctctgttgcctaggccagagtgcagtggtgcaatctcagcttactgtaacctcttcctcctgggttcaagcgattttcctgcctcagcctcccaagtagctaggactacaggcgcttgccaccatgcccggctaatttttgtatttttagtagagacggggttttgccatgttggccaggctggtcttgaactcctgacctcaggtgatccacccaccttatccccctttcagaagtggatttacattttcccttccttggcttgtcactggaagccagccagacccctctgagtaatgctaggagagaaccctgattacacagatcttttatggcctgcagctgccatgagctttccatgtggcagtgaaacagatgacacagcagtgactcctgctgtgctgacgggggatccctgtcctggccccctatgctctatctgcctcttctgcctgctttgcttctagggcaaagcctggttgg

SEQ ID NO: 1785 - DNA, 700 bp, Homo sapiens
acccctctgagtaatgctaggagagaaccctgattacacagatcttttatggcctgcagctgccatgagctttccatgtggcagtgaaacagatgacacagcagtgactcctgctgtgctgacgggggatccctgtcctggccccctatgctctatctgcctcttctgcctgctttgcttctagggcaaagcctggttggtcttggtctggctgggcttctgagtttctcctgggagtgaaactttgacatctaagccaaagggacatgacctggctaggatgagggccagcatagccctaggagtattgcccaccacctgtcacacccctctgaatctgagcactctctccaagagggagtgactcagagagggccaggctgccttccatgtagagcagtacctgccccaggaaccgctgggcccattccacacagaggcaggacatgcaccttcataaatgaccaacataggctctcagtagaccccagctcaagaaacaagactgtagtgcagctgccaggatatgaggcgagacccaggaaccatgggctaggagtgtcctccatctggcacggggagaacctgggttccttgatgctgagttgctactagagtgactgtgataagccgtctttcatggagatattattatgaagactgagatcatgtatgcaaagtgcctaggagggtgtctggc

SEQ ID NO: 1786 - DNA, 700 bp, Homo sapiens
caagactgtagtgcagctgccaggatatgaggcgagacccaggaaccatgggctaggagtgtcctccatctggcacggggagaacctgggttccttgatgctgagttgctactagagtgactgtgataagccgtctttcatggagatattattatgaagactgagatcatgtatgcaaagtgcctaggagggtgtctggcatgtggcaggtgctcagtaatagttattctttatcctgatcaagcagttgaaatgtgctacatgtcaggggagtgatggaaagtacaatgcttttgatccaaaaaggcccagtggaagacagaactcctcttcagggcttaacagatgttcccctgctcagggcttcccctctgtctgcaccaatcactccagtcaaaagtaacatttcctatctctgtgtatacccagcaatatgtgccccactcccttgacccatgtccccatgtccacagtgacagctgcattggctgcagaggcacaaccaggcagtgagctccttgtgaatagacaggagtaagttcttgctcttccctgggtctccccagttcttccctcttacggtgcaatgcaaataaggtatgccagcaaatttctgcatcatgtttacgtatttatatgccagctcatcccttggagattttgaggcaacttcaaatttaaatacaataaaataatggta

SEQ ID NO: 1787 - DNA, 700 bp, Homo sapiens
aaccaggcagtgagctccttgtgaatagacaggagtaagttcttgctcttccctgggtctccccagttcttccctcttacggtgcaatgcaaataaggtatgccagcaaatttctgcatcatgtttacgtatttatatgccagctcatcccttggagattttgaggcaacttcaaatttaaatacaataaaataatggtaacattaaagtaagatataaagaaaagtaaaaagttgtgccttggtgaaaagatcaaaaatacgcagctgactattttgaaaacagtttggcagttcctcaaaaggttaaatatagaatcaccataggacccagcagaggtcctaccttatacccaagagaattaaaaacatatatccacaaaaatacttattctccaatgttcatagcattattcataacagccccaaagtagaaacacccaggtgttcaatgactgatgaatggatgaccgaaatgtgttgtcttcatccagtggaatactaattcatgttacaacatggatcaaccttgaaaacaagtggagtcagtcacaaaggccacataatatatgattctgtttatatcaaatgtgcggaatagggaaatccattaaaggcagaaagtaaattagtggttgccaggggcgaggggaagagggaaatgactgctaattcgtatagggtttcttttcagggtgatg

SEQ ID NO: 1788 - DNA, 700 bp, Homo sapiens
ctaattcatgttacaacatggatcaaccttgaaaacaagtggagtcagtcacaaaggccacataatatatgattctgtttatatcaaatgtgcggaatagggaaatccattaaaggcagaaagtaaattagtggttgccaggggcgaggggaagagggaaatgactgctaattcgtatagggtttcttttcagggtgatgaggagttagatagtgttgatggctgtacaactttgtgaatatgctaaacaccactgaattatacactttaaaagtgtgaatatcatggtatgcaaatctgtcatggactgaatgtttgtgtccctctattattcatacattgatcccctgacctgatagggtataggattagtgttcttacaagaagagacaccagagagtgagctctctatggctcactctctctttcttgctttccctctttctgagcacttgcgcagaggaaagaccatgtgaggacttagggagaaggcagccatctgcaacccaatgggagaaccctcaccagacaccaaccctgctggcactttgatcttggacttctaccctccacaactgtggaaaataaattttggttgtttaaaccacccagcctataggattttgttacggcatcctaaacaggcgaagacaaaattatatttcaactgttcaatttaaaaacagtaaaaaatatatat

SEQ ID NO: 1789 - DNA, 700 bp, Homo sapiens
tgcaacccaatgggagaaccctcaccagacaccaaccctgctggcactttgatcttggacttctaccctccacaactgtggaaaataaattttggttgtttaaaccacccagcctataggattttgttacggcatcctaaacaggcgaagacaaaattatatttcaactgttcaatttaaaaacagtaaaaaatatatatatatgtggctggtaaaagctgcatcattgatgtagttaaatttcaaatttgcctgagcttcctggtagccagagttgtaaaggaagatgccatcacttacacacctatcaaaaggaggaacctctagacatcagaggaagcaaagctttaaatggttcagcatgcccaaagaaatgtcacatggaggttgatgttagaagtactgaaaaatactgaattaatgaatcagtcaagagttttttctgtgttattaaatacagaaacactttttgtgtttaagcagctagttatgggggataagagaggatactgatggcattctacccagaaggctattgacaggtggagggcattatttctgggcaacagtaggagattgtgaggggagctggaacgtgggtagggttagtgtccttggtcccgagtggtcatttcctcctaaaccagcatcattccggcaacaccatcacttccaggcatgtctgctttatgctgtgtag

SEQ ID NO: 1790 - DNA, 700 bp, Homo sapiens
gagaggatactgatggcattctacccagaaggctattgacaggtggagggcattatttctgggcaacagtaggagattgtgaggggagctggaacgtgggtagggttagtgtccttggtcccgagtggtcatttcctcctaaaccagcatcattccggcaacaccatcacttccaggcatgtctgctttatgctgtgtagggtagcactgttctttctttctcttttctagtctgctacgactgtggcagccttgatcattttttaaaagcagcacaaaacaaggactcatttctgcactactttgacagtgggagtaatttggcttcccaagttaatgtgaaattatcatgcagagctttgccaacccttccttagggccagagggtggaagcgaaggcacctaccaaactcctcagcccagaccacaccctttggtttattttagtcaaatacaacctggaattcagctattttatcccagaaacaccagagagcactgctgcactgtagggaagctagcagccaccttgcctttgtactgtgtcccccaaccccaggtgctgactggggcgtccagccattccagagcaggctggttttcagggacacttaaactttcagacctgagaacccaacacaacgagtctcataccaggatacaaaagccagtaatttcctgcagagcacaatggagtaaa

SEQ ID NO: 1791 - DNA, 700 bp, Homo sapiens
gctgcactgtagggaagctagcagccaccttgcctttgtactgtgtcccccaaccccaggtgctgactggggcgtccagccattccagagcaggctggttttcagggacacttaaactttcagacctgagaacccaacacaacgagtctcataccaggatacaaaagccagtaatttcctgcagagcacaatggagtaaaactaccatgaagaggctcccagagcaccctataacaggcctggccccaggctgatagcaagccctgagaggcctggatcccagctgatagcgaggctgctgcacccagggtcttacctactgactggctggcttgactgatcttccatggccttactttccccttggccctcttacccttcttcaccctgcatgtgggaccacatgctgcatgggaactgggaggagagtagatgatagtgtcagagccggcgggggagggcagccctttcctgtaggaagcctggggtatgctctccctgcctcacccgctcacacaggggaggcttggaggctccagaatcaccctgtgccactaaaaaggcagatctcagtgctgcccattctatagaaccggggatgccaccacctggcacaagtcccaccttgttcccattcccacggagagagcttctctggcttcaccgtgactctctacccttctgttccagatggtccttc

SEQ ID NO: 1792 - DNA, 700 bp, Homo sapiens
gcctcacccgctcacacaggggaggcttggaggctccagaatcaccctgtgccactaaaaaggcagatctcagtgctgcccattctatagaaccggggatgccaccacctggcacaagtcccaccttgttcccattcccacggagagagcttctctggcttcaccgtgactctctacccttctgttccagatggtccttcaggtcctcctgggatatgggcctgctggtcagagtcctccgttttggggaggcctgtttggcttttggtatgtgtctggcccaagcagagccacatgttgggtttttcaggcttagggaggatcgtcacatggaagatggattctggggactttgaacatgaagacaataggctttgccttgtgttcttggagccactggggactaggaggttgcaatttctatcttaagttcctccaacctccagtttccaacaacactggcctgaagctccctgtgccctctacacaaatgatcttcaagaaaatcttgccccgctccttccccctgcaggaaggggagcagcctcctcccgctggggcctgctgaagagtgtgctacctgctgggaccatgtggctccagcatgttcttcccaccttgtctcctcccttctcccctctgcagacactgaggctgagcccatggcacggggctcttcgcaaataattaaaggagtaga

SEQ ID NO: 1793 - DNA, 700 bp, Homo sapiens
agaaaatcttgccccgctccttccccctgcaggaaggggagcagcctcctcccgctggggcctgctgaagagtgtgctacctgctgggaccatgtggctccagcatgttcttcccaccttgtctcctcccttctcccctctgcagacactgaggctgagcccatggcacggggctcttcgcaaataattaaaggagtagagttggaatatttccatcctggcaacttgacagaaggtgtacacaccatcaattaagacagtgcagcatctccaaagccaacgagtccttcagactcttaaaaagcaatcagagtcacctaaccagattcggacttttgaggcaagaagaatcgttagacttctattaaaggagtattattaataatgacactgtggacaatagggacaaattgggatggtactgagccacctagaatatattatcaccctagagatgatgggaactggtgtctactgtcccagggatacccctcacctctgcttctctcatttgcccattcgctgggctcaagagaacacactctctcactcctgtggatgaccctcatcaactcgcctggagctcacctaactccctcccaggaaaagctgctgagggccccagggacctcttcatgaccttgtaactgatgagtcttcctcatgcagcctgacaggagatggggctatcagtgtgggg

SEQ ID NO: 1794 - DNA, 700 bp, Homo sapiens
gcttctctcatttgcccattcgctgggctcaagagaacacactctctcactcctgtggatgaccctcatcaactcgcctggagctcacctaactccctcccaggaaaagctgctgagggccccagggacctcttcatgaccttgtaactgatgagtcttcctcatgcagcctgacaggagatggggctatcagtgtggggaggcttgtcctgtgcttagctgataggctctggggtgggctctaactcagggtgaggccagataggcccagtgatggcgggctggcactgaactccccctgtctgacatgagcctccccacctgtgtactggccacagtgactaccctaagtctcttcacaagcaaccaggaagaagtctcaagcctacacaactcagatcaaagacatcctcaggctgcccttcccctaaactgtcctcctctgtgcctctcttaagccctgtgctccagagaatgtgtctcagctgttgtgcagctggttcttaatggctcctgctcttcttctccaccacatttcagggctcagcacagaggtggctccctgcgagtgcctgccctgcccctgacttgctccaagagctgtggctacggctccctcccaagacacatatatccaaaggctttggaagcacagcccaatggcccaatgatttcctctttctgggcctttcagagggtt

SEQ ID NO: 1795 - DNA, 700 bp, Homo sapiens
ttcttaatggctcctgctcttcttctccaccacatttcagggctcagcacagaggtggctccctgcgagtgcctgccctgcccctgacttgctccaagagctgtggctacggctccctcccaagacacatatatccaaaggctttggaagcacagcccaatggcccaatgatttcctctttctgggcctttcagagggttagagggaagcaccccatgtcccagaagccattcctacctagtatgaaggctaccacatagttggagatctggcccatgcccacgatgacaaataacacagtgaacatctcccagctgatggagaaaatctgcaggaagctgaagccagtctgtacagccatggttgcgaagagaacgttcttcctgccaaacctagagaatgcagtataacacaaaacatgagatgtgtaggttgccaaggtgtgttgcaagccctgagtcaggcatcaatgcagacttagtgttttttcagggctctggcagacttttttctctgtcacatcctcccatcttcctccttggtgaggtctcaggcatccatctgctcaggagatatcttttgagattctcagcttcctgtggagacaccatgtctcaaaagcatggagcagtgtacgcaaggaccttgtggaaatatgctctttagaaggagccacagatagatgctaccagcacatttc

SEQ ID NO: 1796 - DNA, 700 bp, Homo sapiens
cagacttttttctctgtcacatcctcccatcttcctccttggtgaggtctcaggcatccatctgctcaggagatatcttttgagattctcagcttcctgtggagacaccatgtctcaaaagcatggagcagtgtacgcaaggaccttgtggaaatatgctctttagaaggagccacagatagatgctaccagcacatttctggaaagtgggtacagcacagattgcagatatttcttgaatcagcaacatgaaaattctgtaaatccagaactaagagtcactctgcaagtggtttttaaccttggctgcacttggaatcacccggagagcttggaaaaaatactgatgccagcaccccacctcccaagattttgggatacagtttgggtattaggatttgggaaagtttcccagatgagtagcgtgcaacaaaaattgcaaaccactgctctgtgggaaggtgtagctttcagcaatgtctgttggtgacactgaagttgttttaagtattatcttcacattctggtagtgaccagtggatagaatggagcacaggtgtgagcagaacagcctttcccgccccattttccaaactcatgtctctggctgttggcttgggctgggaggctttccccagcattgccatttagtacccccaccttcctgcactggtcacccagcacatacaggggcctgtgg

SEQ ID NO: 1797 - DNA, 700 bp, Homo sapiens
gttttaagtattatcttcacattctggtagtgaccagtggatagaatggagcacaggtgtgagcagaacagcctttcccgccccattttccaaactcatgtctctggctgttggcttgggctgggaggctttccccagcattgccatttagtacccccaccttcctgcactggtcacccagcacatacaggggcctgtggaatactgtctcctggtgctgtgatgctgcctcctcaggcctgtaagctctatgagggtcagagccagcatcagctctgtggccccagtgcctggcccagggtccaagccacagcagcagtgtgtgcacagttggggctcactgtctggctgctggctgtttgcagacagatcctgtgccatccacccctacccctgaggtggtggtggagcagggagggcagtggtgatggcagcgtcatgttttgtcaaggagtctgtggtatgaggaccccactttccagtggggtcagtggcccctccccaccactggccaaagccctgggagcatgaggctgggagaatggaacaaaagtgtgtccaggtgaaggggactgagggcggggtgaataggagacatcggggctcctcctatcactgaatcagtggcctgagggtcctccctttctctgggtagaaataccctgaattcagtccagccccaagataggcagtgattgac

SEQ ID NO: 1798 - DNA, 700 bp, Homo sapiens
cccaccactggccaaagccctgggagcatgaggctgggagaatggaacaaaagtgtgtccaggtgaaggggactgagggcggggtgaataggagacatcggggctcctcctatcactgaatcagtggcctgagggtcctccctttctctgggtagaaataccctgaattcagtccagccccaagataggcagtgattgacaaggggcaccatcccaccttcctcccctcccatgtgcttacctgtctgacagctgcccggacacgaaggagccgaggagcacgcctacgaagaacagggaggtggtgaggggcaccttccagttgtcctcacacaccagattccactgccaaggaagacagcatgaagcgtgagcccaaccctgaggcagacctcaaccccagcccagctctgagggaatattagcacggctggcgggcagactctcctcccctgggccaggatattgcctttgtacaaagggcataggccttgcagccctgggtttgactggcctgtgccgggactggggagagtaacctggggcaggtcactgccctccctgaaactcaggatcctctttggaaagggagggtgatgctcctactccgctcgcattacatagcaagaagccagccaaggccatggctgtgactggtgacccctcagctgtgaggcagtccaaagtaaaggtggcactg

SEQ ID NO: 1799 - DNA, 700 bp, Homo sapiens
tgggtttgactggcctgtgccgggactggggagagtaacctggggcaggtcactgccctccctgaaactcaggatcctctttggaaagggagggtgatgctcctactccgctcgcattacatagcaagaagccagccaaggccatggctgtgactggtgacccctcagctgtgaggcagtccaaagtaaaggtggcactgcatcttcagaagccagcctagtgcggaggggaggtgtttgaaaagcccaaagggcagggcagagggcatggccacttggtccaggcgtaaaatttcttttcccttgttgaaaagtgcaagtggttccaggagctctgtgactttattttctgagcaggcccctctgagaaatcatgtggtccctggtccactcacgcctaggccaagcttgtggcctgattcggggccccatcgttctggggcctacttactcctctccagggctccctagctcccctcctacatccctacaccctccttcccatccagtctttccagaagtgtggtccctcccattccctagggtctgtgggatgctgctgccctaacaagtccctgccagtgcatctacaaaatgagtttcagccagagtttcagtttgacttaagtcaattaagcaacatctcaagggaggtgacaaaaatttcaaagtgtgtttagtgacctttcatttattaaaa

SEQ ID NO: 1800 - DNA, 700 bp, Homo sapiens
cccatccagtctttccagaagtgtggtccctcccattccctagggtctgtgggatgctgctgccctaacaagtccctgccagtgcatctacaaaatgagtttcagccagagtttcagtttgacttaagtcaattaagcaacatctcaagggaggtgacaaaaatttcaaagtgtgtttagtgacctttcatttattaaaaacaaataaataaacaaacagatgccaatgagcactttgggcttgggttttgggggctgctgtctgtggcgagatgatccagtctggaggaaagacccctgcctcccacccagccctagctccatcttggatggggctgcttttactgcattcgccaaacaattccttctgaatcctcacaactcccttgaaagtgtggtggatttaagcacaaactcacatatttatatcacaccttattctgcagcagacagaggtgtttataaagacacacacaagagaaaaatgtaaaacaaaaagctaagggaattggggaaaatggaaaataaagaggagggaagttgcaaaaaccaagcctggggtaagactgaccctagactatcctgtccacgggcctgcctgcttgccagacggggctccaaaactggctctgcgtatcccagcagctcagctctcagaagggttacagtatccgaagtagtctgcttattcgcagaagca

SEQ ID NO: 1801 - DNA, 700 bp, Homo sapiens
taagggaattggggaaaatggaaaataaagaggagggaagttgcaaaaaccaagcctggggtaagactgaccctagactatcctgtccacgggcctgcctgcttgccagacggggctccaaaactggctctgcgtatcccagcagctcagctctcagaagggttacagtatccgaagtagtctgcttattcgcagaagcacagttgttctgaatactgagatccgaaagaagtgtctcctatgtacttcttccacaaaggagccactctgtgatgctgaggataatgtcctcgagaatagtcctgtcctagagacaatagcaagattcatgaggccgcctgtcacagtgctcaaatgctggccacaggcaacgcccaacacagctctgcagaagaaaaacaactcgggccaggaagttagcgctctgctgctcaggcacaatccaaggataaatctcagactgtacccagagcaggattgcctcgcctggggctcttgcatgggcttcaggagaaagggaaatgaatcctctaaaactgtatggccagattaatgtgttctgccagtccatagaccggaagtggtaaacaggacgtgtgcctgcattcatggccatctccctccaaaaataattgtccaaagcttcagataaaagcttgggttctgcttctgacttagagagatgagcaattgaggccca

SEQ ID NO: 1802 - DNA, 700 bp, Homo sapiens
tgggcttcaggagaaagggaaatgaatcctctaaaactgtatggccagattaatgtgttctgccagtccatagaccggaagtggtaaacaggacgtgtgcctgcattcatggccatctccctccaaaaataattgtccaaagcttcagataaaagcttgggttctgcttctgacttagagagatgagcaattgaggcccaaagcctcatgatgtggtgtgacccattttgcagaagattaaactgagactgtgagaatgggatttgtctgaagtcatagcaagtaaatgagcatgatagatacctacttgggcctcagaacccaatcttgtaccagtgtcctgctttggacctatactccctaaggcaggacaaaatgagcttattaaatatgatgccctacacttcttcaaggaatgtgataccaggagacaattacccaggactaggagtagaaggcctccatcacagcctttagcctcagactgagccaagaagaactcaagattggtagaggcattaacatgccaaccatcatcattccatctgcagttgagcagaaaagctctttcaaatataatgtgctctcctttgtagtctgtcaaatatttttctgtctggactttgccttagggcaggatagataggatttagagatagaaaggaatggaaggctgttagatgtggagccaggcattgca

SEQ ID NO: 1803 - DNA, 700 bp, Homo sapiens
tcaagattggtagaggcattaacatgccaaccatcatcattccatctgcagttgagcagaaaagctctttcaaatataatgtgctctcctttgtagtctgtcaaatatttttctgtctggactttgccttagggcaggatagataggatttagagatagaaaggaatggaaggctgttagatgtggagccaggcattgcatgagcaaagggtaggactgggaactggctacttaatttgcaaggtccagggcaaactgaaaatgcagaactccttggtcaaaaattattaagaatttcaatacagcaatggcaaagcattgaaaccaagtgtggcgctctgtgtgactgcacagttgcatgcccatgaagctggccctggcaggggatcaaacctggcctccaggaaatgaagcagatgcaggagttctgaatggggacactgggaaggggggtgaggtgagggccatctcccatcattctccttcctgtaggctctgcatcgatggctttcggtcccattccctccctgaagaggggcccaagaagccctgtcagcatcatgcagcacaggaagagccatgcacacgcagtggccgtttgccccaagcccatgaggggtgccatctgcctttggagaccctgcttacaaccagcaggggaaggcagctagactgcatggctgcccatggttgattctag

SEQ ID NO: 1804 - DNA, 700 bp, Homo sapiens
tcgatggctttcggtcccattccctccctgaagaggggcccaagaagccctgtcagcatcatgcagcacaggaagagccatgcacacgcagtggccgtttgccccaagcccatgaggggtgccatctgcctttggagaccctgcttacaaccagcaggggaaggcagctagactgcatggctgcccatggttgattctagggctgggctctcctttggggagttatggtgccgcaagtgtctttttggaaagctgtgaggggcctggtattaggacacaggattggcagatgaagttctacctggagcgaagggctagagtccagtaaatcagctgccagtcctaagaggggtcctttagaaaaggcttttcttaggaaaccggccctgcctgcccctgggcccttcaggtttgagggatatgtcttgggtctccgctagccagggccacaaaacctccctgtggttaacagtgacatggcgggcccagtgggagacagtgttttccttgatgggacagacctgtccctgtgggtccctgcacatgtttgtacatacatgcacacacacatacatacacatgaccagctcagaggctaatggcagatgtcctggtaaggagctggctggcattgctttgggggtgtgctttcaagtcaaatcctaacatttctgaaacatagcttacctcccctctccct

SEQ ID NO: 1805 - DNA, 700 bp, Homo sapiens
gttttccttgatgggacagacctgtccctgtgggtccctgcacatgtttgtacatacatgcacacacacatacatacacatgaccagctcagaggctaatggcagatgtcctggtaaggagctggctggcattgctttgggggtgtgctttcaagtcaaatcctaacatttctgaaacatagcttacctcccctctccctgcccctctgatggggcctcccggggttactatgtctgtcccatcagcagggtcccagaccaaggttctcacaacagagcagagtgagctccatttagctgggccgcatggccttcagctctaatttaagaaacaaaaatccaggtgacaaggtaataggggataggaggtcactcttggcatagaaggatgtgccgcttcccatggctccctatagtaaagggagtaatgggaaagacagtaacagtgtgtggagtgctcactgagtgccgtgtattatctcaggggatctcagggttggcatgtgagatgggtactcttatccttgttttacaaatgaggaaatgaaggcacagagcaataaagcaaccagcccaagttctcctagtgaattggtaaaaaaaaaaaaaaaaaaaaaaaaaaaaaaaaaaaaattgcttaatcattgattcaactgacattcagcacctacctgctccaggccaggctctgtgtagggca

SEQ ID NO: 1806 - DNA, 700 bp, Homo sapiens
catgtgagatgggtactcttatccttgttttacaaatgaggaaatgaaggcacagagcaataaagcaaccagcccaagttctcctagtgaattggtaaaaaaaaaaaaaaaaaaaaaaaaaaaaaaaaaaaaattgcttaatcattgattcaactgacattcagcacctacctgctccaggccaggctctgtgtagggcacaagaaagacatggtccctgccctcacaaagctcaaggtcaagcatactttacaggacagatgtgcacatgtgcatgcatgaggccagcagccctgggtggggtgggcgctgttctgggccacttcacccttgctctttggctagagaggaaagaggcaccccctcctcaccatcctccagcagaaggacagagttctaaaacctgaataatccgtataatcatattttagatgactagtgtttgcacagtgctaggcacacagtgggtgcttaacaaattgttgaatgaatattgaacaattaattaggagtcatagaaaatcagcctggaaaatgtggttcttgggctgaggagtatcacgcattgcacttggaaaatcaccctcagccttgaactaactctccaagtagccaaagtctggcagttttagtttttaccagagctataaaggaccataaagataagtgaaccccgtctgacctgcacggaactgagaac

SEQ ID NO: 1807 - DNA, 700 bp, Homo sapiens
attaattaggagtcatagaaaatcagcctggaaaatgtggttcttgggctgaggagtatcacgcattgcacttggaaaatcaccctcagccttgaactaactctccaagtagccaaagtctggcagttttagtttttaccagagctataaaggaccataaagataagtgaaccccgtctgacctgcacggaactgagaacgctggaaggtagcctggtgttcagcaaagaacacaggctttctcggggtctgcaactttggactgtgtgatgttgggcaatccattcacctctattagcctgcttcttcaccttcaaaaagatgacaataatacctgctcctaggtttgttgtgtgcattggatgggaaatatcagtggagcgtctgacacattacaggcctcattaaatggtagttccctttctaccaggctcatactagtagagcattttatttgtcctgagcaaaatcatgacttggaacacatggacgaataagcaaagcaggttacacttaaatctgactaagagaaagaaattctaagaaataaaaattattccagtccattactaaaagctagaaaagctcttataaaagggatttgataaatggaattcaatcccagagatgactgtgagtgaaaaattagcaatggtccttttaagaataaaagattgatttctatagtatcctctcatag

SEQ ID NO: 1808 - DNA, 700 bp, Homo sapiens
aagcaggttacacttaaatctgactaagagaaagaaattctaagaaataaaaattattccagtccattactaaaagctagaaaagctcttataaaagggatttgataaatggaattcaatcccagagatgactgtgagtgaaaaattagcaatggtccttttaagaataaaagattgatttctatagtatcctctcatagttatcctttattctagagaaaagtaagaagtagtagttaataatggactatacatccaccccagttctatctttgtcacttgattgtgacttaaagctgggaattccttgacaatatgaaaaaacaaaacaaagaaaaacaaaaacaaacatggctagttaattacttttttgtaacaactttattgagatatgatttatacaccataacatttactcttttaaagtatacaaatcaatcatttttagtatattcacagacttcagcaaccatcagcaatgatctgattttagaattttcatcacccttgaaagaaaacccatacctgttagcagtcactcctcattcgctacttcctctagcccctggaaaccactaatctactttctgtctctatgaatttgcctattctggacatttcatataaatggaatcatacaatatatagtgttttatgactggcttcttatacttagctccttttctaagtccatccatgt

SEQ ID NO: 1809 - DNA, 700 bp, Homo sapiens
atcacccttgaaagaaaacccatacctgttagcagtcactcctcattcgctacttcctctagcccctggaaaccactaatctactttctgtctctatgaatttgcctattctggacatttcatataaatggaatcatacaatatatagtgttttatgactggcttcttatacttagctccttttctaagtccatccatgtcattgtgcagtgtatcagcacttcattactttttatggtttaataatatgccatggtttgggctgggtgcggtgggtcacacctgtaatcccagcactttgggaggccgaggcgggtgggtcacctgaggtcaggagttcaagaccagcctgggtaacatggtgaaaccctgtctctactaaaaatgcaaaaattagctgggcacggtggcacgtgcctgtaatcccagctacttgggagactgaggcaggagagttgcttgagcctggaggtggaggttgcagtgagctgagatcacaccactgcactccagcctgggcaacaaagtgagactccatctcaacaacaacaacaacaacaactatatatatatatatatatatatatatatatatatttcacggtttgggtctaccacgttttcaatgatctgttcatcagttgataagtagttgggttgtttccactttttggctactatgaataatgctgctgtgaac

SEQ ID NO: 1810 - DNA, 700 bp, Homo sapiens
cactgcactccagcctgggcaacaaagtgagactccatctcaacaacaacaacaacaacaactatatatatatatatatatatatatatatatatatttcacggtttgggtctaccacgttttcaatgatctgttcatcagttgataagtagttgggttgtttccactttttggctactatgaataatgctgctgtgaacattcatgtacaacattttgtgtgtacatgttttcatttctttggggtatatacatagtagtgaaattgttgggtcatacggtaagtatatactcaaccttttgcagaactcctaatctgctttccaaagtggctacaccattttacaatcccaacagcaatgaatgagggtttcaatttctccacattcctaccagtacttgttattgtgtgtctttaattttagtcattgtagtgggtgtaaagaggtatctcattgtggttttgattgcatttctctaataactaatgttgaacatcttttgcattgaatctattgatcaatttggagagcactgccatactaacaataagtcttctgctccatgaacagaacatgggaagcttttccacttgttaaggccttctggaatttctttcaatgacattttatagtttttaaagtatacattttgcaaatttttggttaaatttatttctgaagtgcctcctttaatattt

SEQ ID NO: 1811 - DNA, 700 bp, Homo sapiens
tttgcattgaatctattgatcaatttggagagcactgccatactaacaataagtcttctgctccatgaacagaacatgggaagcttttccacttgttaaggccttctggaatttctttcaatgacattttatagtttttaaagtatacattttgcaaatttttggttaaatttatttctgaagtgcctcctttaatatttcttgtaagacatcactgctagaaacaattctctcaagttttgtgtatttttgaatttctttatctcagttttgaaagacagttttgttggatgcatgattcttggttgacagtttcttttttccttcagcacttagaatatgccactccactgccttctgtcctttatggtttctaatgagaagtcaaacgttgatcttattggagttctcttgtatgtacctagtcatatatttgctgctttcaaaattttcccttcgtttttgtctctttttttatttaagcagttttaccatgatatatcagggtgtggatctctttgtgatcattctatttggagtttgttgagcttctgaaaggtgtagattaatgttttccaccaaatttgggaagttttcagtcattatttctttgagcattttttctgcccttttctctctctctcctctcctagtaattctattatgcatatattgctatgtttaatggtgttccccattt

SEQ ID NO: 1812 - DNA, 700 bp, Homo sapiens
atcagggtgtggatctctttgtgatcattctatttggagtttgttgagcttctgaaaggtgtagattaatgttttccaccaaatttgggaagttttcagtcattatttctttgagcattttttctgcccttttctctctctctcctctcctagtaattctattatgcatatattgctatgtttaatggtgttccccatttctctgagactctatacattttctttattccctttttcctctctgttctttggattgcataatttccaatcctctatcttcaagtttgctgattctttcttttgcctgttcaaatcttctgttaaggcccttgagttacttttaaatttcaattattgtatacttttactccagaagttctattcagttgttttgtttgtttaagagacaaggtctctttctgttgcccaggctggggttgaactcctgggcttaagcaatcctcctacctcagcctcctgagtaactgggactataggcacatgccatcatgtctggctcagcttttaaaaatataaatgtaatttttctctctttattgctattctctatttgatgcaatattgtcatcatacttttaaaagcatgacttcctttcattctttgaacatatttataatggctgccttatgccttaaagtctgttaaaatctgacatgtggaccctctcaggcagttact

SEQ ID NO: 1813 - DNA, 700 bp, Homo sapiens
catgccatcatgtctggctcagcttttaaaaatataaatgtaatttttctctctttattgctattctctatttgatgcaatattgtcatcatacttttaaaagcatgacttcctttcattctttgaacatatttataatggctgccttatgccttaaagtctgttaaaatctgacatgtggaccctctcaggcagttactgttgcccacgttttccccccatgtataggtcatatttttctgtttctctgcatatctcgtaatttctggttaaaaactggacattttagataatatattgtagaaattaggtactgtcacattcttccacccccatttccctgatctttcttcttcttcttttccgagatgaagtctcactctgttgcccaagctagagtacagtggcatgatctcggctcactgcaacctccacctcctgggttccagcaattctcctgcctcggcctcctgagtagctgggattacagggacctgccaccatgcccagctaatttttgtatttttagtagagatggggtttccccacattagccaggctggtctcaaactcccggcctcaggtgatccacccgccttggcctcccaaagtgctaggattacaggcatgagccaccacgccagtctgatctttctattaagctgtctgtgtctgctggtatcacacccagctgttagcc

SEQ ID NO: 1814 - DNA, 700 bp, Homo sapiens
ccatgcccagctaatttttgtatttttagtagagatggggtttccccacattagccaggctggtctcaaactcccggcctcaggtgatccacccgccttggcctcccaaagtgctaggattacaggcatgagccaccacgccagtctgatctttctattaagctgtctgtgtctgctggtatcacacccagctgttagcctcactaattgctagccagttgcctcattcatttcaataatgccctgggggcatatattgtcccacagtctaatccagttgacgtcaagcctctttgcagtggtagtttttgaggcaaatctataaggtttgttttgactccagaagggctgctcttagctgtctctttcttgttttgtttgtttgtttgttttctgttttttcctggtaaactagctgcattatgggttcatttgttgctctaatggagttaccagaatccttttagttgcttaccactaaattctccattgttcttgagagcaatcttaggctgtcctttcacacactctatttcaaataaagttcgttcctgtggggacagctttagaactctgttcttttggattatctctccccgctgggcaaaatatctgagctcctgttgtagagaggtaggcagggaaagcggcccatttatctcagaatgacacccctactttatgagtcagacactgagtg

SEQ ID NO: 1815 - DNA, 700 bp, Homo sapiens
agcaatcttaggctgtcctttcacacactctatttcaaataaagttcgttcctgtggggacagctttagaactctgttcttttggattatctctccccgctgggcaaaatatctgagctcctgttgtagagaggtaggcagggaaagcggcccatttatctcagaatgacacccctactttatgagtcagacactgagtggaagtgggagcttggtgtggaatctctgccgtatgaatgagctgggataagggcaatcaaggctctaatattctcaacttgtggcacctggagtagagtctctactatatgaataggcggtgggtggaggatgggaacctatgatcccctggttgcactcacgaggattttaccttctgtggtttggagctaagagaatacagggatgggtgggggatgggcattggttgtccctcttggtgggctgctgtagcccttccttggaagctgatgggagagagaacagtattttcttggccatacccacctagagtggaacttccatttttcttgtgctgggaggaaggggaaggggagggctgaaggagttatgactcaaatatcatagacttcactgttcttgccaaggtatagtcgactttcttgaataaatatatgcccttaggacaacttccagagactctaaatgtgtgtgtgtgtgtgtgtattttcaccagtta

SEQ ID NO: 1816 - DNA, 700 bp, Homo sapiens
tacccacctagagtggaacttccatttttcttgtgctgggaggaaggggaaggggagggctgaaggagttatgactcaaatatcatagacttcactgttcttgccaaggtatagtcgactttcttgaataaatatatgcccttaggacaacttccagagactctaaatgtgtgtgtgtgtgtgtgtattttcaccagttatggctgtttcactgaggagctggtctatggcgctggcgctcctcacactgctaacttcgaagtctcagaatcttttcatgtgctaattgatttgtatttctttggcaaaacatctattctccaaaatgggcaaatgattttatccatttttaaatcaggttgtctttttattgctgagttatcagagttatttttatattctagatacaaatcctttatcagatatatgatttgtcaatattttctcccattttgtgggttatctttttggctgtttaattcttctactcatattttcatttacaaacaactaagccagaaggctgctaagccttaaaatgttctcagtatctttctttctttatattagaaaagctaccacagatggaaaagcctcactgatgagttctgtgatcattggaggctaaaccaaagcagaagaaccagtgagtgtgagtgggaagatagggatgggagtggaggggctgtgggaaggagaa

SEQ ID NO: 1817 - DNA, 700 bp, Homo sapiens
ttacaaacaactaagccagaaggctgctaagccttaaaatgttctcagtatctttctttctttatattagaaaagctaccacagatggaaaagcctcactgatgagttctgtgatcattggaggctaaaccaaagcagaagaaccagtgagtgtgagtgggaagatagggatgggagtggaggggctgtgggaaggagaagggtcactcagggacctggctgtgccccttgcatcctgacaatggatccaccacagctctaccagtctgtattaggggaacatgagcaaatggcatcgtgtctgtgccagtcaccaagcactgaggggaagctctggaagttgccgcctgaacctgccctccagtcttgcaaatgctgagcaggagccaccagccttggactgtctgtgcttcttgctagagcatgtgggtcattccagcctttccccagaacgtccattctctccacaccttcttcattccaaatggggatccttgcctttcttttggactccagagacatgcataaaaccacaacacagctttagaaaacaaggcacacctgtattagtcttacacctaaattgaatgcagcctgccataagggaggaattacagtccttctagaggcccaaggtacctgcagctccccctgaccagtcctgtcaaagccttgtttttgtcaaaatgccaccttggac

SEQ ID NO: 1818 - DNA, 700 bp, Homo sapiens
ttcttttggactccagagacatgcataaaaccacaacacagctttagaaaacaaggcacacctgtattagtcttacacctaaattgaatgcagcctgccataagggaggaattacagtccttctagaggcccaaggtacctgcagctccccctgaccagtcctgtcaaagccttgtttttgtcaaaatgccaccttggactctgtctgagagttctgctgcccaccaagagggatggacaaagtctgtttatccagaaacttggcaggaggtgcaggtgaagcagcctctgaacaaaagcatattctgagatcctggtggctgttgtcagaggaacacagcagagaggcaaacagtttggggtgaggcagctgataaacaaacagggaagcacattcaggccagagcaaggggaagcccctgagtctcctctatgtgctctctggcaagatctactttctgaagcattgactggaaatagaagtctcgccgggctggctggagccagaggcccccacaccttatcccctttggaatctgccagagggcaggtctgagtatggacttggatgatcaacttggttaatattcaggctatcttgacagtctccacacccgtgagcaatgtcccagggcagcctgcaggcctgatagaaactccacaaacctgcctatcacggaaggttttccccttttgtcgg

SEQ ID NO: 1819 - DNA, 700 bp, Homo sapiens
gagccagaggcccccacaccttatcccctttggaatctgccagagggcaggtctgagtatggacttggatgatcaacttggttaatattcaggctatcttgacagtctccacacccgtgagcaatgtcccagggcagcctgcaggcctgatagaaactccacaaacctgcctatcacggaaggttttccccttttgtcggggcctacccagaccccaggggaggtgcatccttgagagccgctatgtgaagtcccacatagtggcagccgcatgtgagggttagtctgtttcattattcccttgcttgctgctctcagtgcctcccagaagttccccgttagcaggggaagaggccttatccttcgccacataacctggctcgcctctgggttatgggtggggaatcagtaagtcctactgctgttcaggccctgaccccagttcccaggaaagcacaaggctagtgccaccagaggtccaggccctttgctggaggctccatcaactccactaccagtgggctaccagcagctccactagggttcctagaggaggcagcccagctgcagaagaggacaggaggatctacggtgtggcagcagccctgtcttagatcactggtggcctgcaaagaaggctggtccttaacacacaaggttcccccagggcctctggagcacaagacctggcagaagtggt

SEQ ID NO: 1820 - DNA, 700 bp, Homo sapiens
catcaactccactaccagtgggctaccagcagctccactagggttcctagaggaggcagcccagctgcagaagaggacaggaggatctacggtgtggcagcagccctgtcttagatcactggtggcctgcaaagaaggctggtccttaacacacaaggttcccccagggcctctggagcacaagacctggcagaagtggtatccagcttagaggtgactgcctcagttttcccagcccatggactgatgggaaggtcaagaccctaatgatgctccatgggagaagaggacatgcttgaggcaaaggccagcccatgcttagcccctggccacgagccaggattgcctctgctgcttgccctgtggccctgcagatgaacttaggccctctccagagcagagcatttgttgcccttcctgctcctttagcctcagggcaggaggctgccgggtttcctcacacgcagggcctcttctctctgaggtcttggccctgagggctatatatgaagggccatgcccatggagactgagatctgacccctgcagtaggtctcagggatgaggaccccagcatcagacactctgggttgcttggggcacttccttccccaacagaagcttcagtcccaacccaggtcccaccagtccctgcttgcgttcctgctcaactgctgcctgatggaaaacttagcaacga

SEQ ID NO: 1821 - DNA, 700 bp, Homo sapiens
ctatatatgaagggccatgcccatggagactgagatctgacccctgcagtaggtctcagggatgaggaccccagcatcagacactctgggttgcttggggcacttccttccccaacagaagcttcagtcccaacccaggtcccaccagtccctgcttgcgttcctgctcaactgctgcctgatggaaaacttagcaacgagctgtgactggcactcctcccgcaggggtaaacacagactcctctagccctgactgcagagacagataaaggcccttaccctggatatctacattctctatccttaaagtgaaaaataacttggtttgagctagaataactggagcaacaaaataaagatggatagcattagtttataactgatgaaataaaataagtatgtatgaacctgtactgatataagttaacaattgcatacattaataaatagatgtggaggggaagctcttcttctcagaagaattccaattaataaatgttgaaggaatcagaaaatgcaaaatcatcactaggcaaactgcagtaataattgtttcagtcaagacctagtgatgaatgctaaaatcagtgaataaaaatttgaggagacacaggattttgtataatctcgaagaacctcccttaagatatttattagtgacagaggaaaaaatagtacctttacagcagagaaattccac

SEQ ID NO: 1822 - DNA, 700 bp, Homo sapiens
gaaggaatcagaaaatgcaaaatcatcactaggcaaactgcagtaataattgtttcagtcaagacctagtgatgaatgctaaaatcagtgaataaaaatttgaggagacacaggattttgtataatctcgaagaacctcccttaagatatttattagtgacagaggaaaaaatagtacctttacagcagagaaattccacagacaccaacttgacaaatgatcaaggttaacatcaccagtaataagacacatcagcatcatgtacccactggtatgatgcccagagaatgcatcacttctaaggtatcattaccaaaaagtgcataacgcaatctaattgtgagaaaaatcatgccaacccaaactgaggagcattcatcaaaatactcataaaaatgtcaagatcatgaaagataaggaaagactaaggaacaatcacagattggagactgagacatgacaactaaatacaacatgggattttggatgggatcctacgatagaaaaagggcagtagtagaaaaactggtgaaatccaaacaaagtctgtagttcagttattactattgtaaccaatgttaatttcctggtttggataaatgcataacgcgtatttaaattgttaacatcagagaaagctagatgaagggtatatgtgaaatctctgtactattttcaaacttctctctaaatcaaaag

SEQ ID NO: 1823 - DNA, 700 bp, Homo sapiens
atagaaaaagggcagtagtagaaaaactggtgaaatccaaacaaagtctgtagttcagttattactattgtaaccaatgttaatttcctggtttggataaatgcataacgcgtatttaaattgttaacatcagagaaagctagatgaagggtatatgtgaaatctctgtactattttcaaacttctctctaaatcaaaagttatttcaaaataaagttaaaaaataatcgccaggcgcggtggctcacgcctgtaatcccaacactttgggaggccgaggcaggtggatcaccttaggtcaggagttcgagaccagcctggccaacatggtgaaaccctgtctctactaaaaatacaaaaaacaaacaaacaaacaaacaaaaaactagccgggcatggtagcaggcccctgtaatcccagctactcgggaggctgaggcaggagaatcgcttgaaccaaggaggcagaggttgcagtgagccgagatggcaccattgcactcctccaccctgggcaacaagaacgaagaaagaaactccatctcaaaaaaataaaataaaataaaataaaataaaataaaacgaaaaataatttgactcttagtaactgcacaggttgaaaaacttggacctcacaatcaacccctgaagaaggaaactaccttatacacatgtacacacacagacgaatgcactcacg

SEQ ID NO: 1824 - DNA, 700 bp, Homo sapiens
ctcctccaccctgggcaacaagaacgaagaaagaaactccatctcaaaaaaataaaataaaataaaataaaataaaataaaacgaaaaataatttgactcttagtaactgcacaggttgaaaaacttggacctcacaatcaacccctgaagaaggaaactaccttatacacatgtacacacacagacgaatgcactcacgcaaaccccaactcagacaccttattgctacctcctggcatactatgaaaggcatttctacagcacagcatgccatccttggttcctggctaaccctgtcctcctgtgaagaggtgttggggggcagttcaggcagacttgtctgtccccaaagatatgcccattgggagatcctggcacggcagtataaggcaaagacacaatctgaggacagtcccactacctgtgttgtgccaactgggatgcagagaaccttctcaggggccctgggcttggccctgtacactggcactggccaagtcagtatgggtttggacttgtgttctattctctgaggcttggaactgccactgtggggagaggggctcagcctccagcaagtcccatcacctattacacaggccacaacctggactttagaacagctcccaccatgcccactgtccccagccagtggagaaggcaaagaaggtgctgagcttctgcctttaccactcctca

SEQ ID NO: 1825 - DNA, 700 bp, Homo sapiens
cagtatgggtttggacttgtgttctattctctgaggcttggaactgccactgtggggagaggggctcagcctccagcaagtcccatcacctattacacaggccacaacctggactttagaacagctcccaccatgcccactgtccccagccagtggagaaggcaaagaaggtgctgagcttctgcctttaccactcctcaccaccacctaggaagcccatttgctggtgccacactctttgctggtgccacactctgtgctggccaccaccggatggggcatggggcattatctcactgagtcctcccaacaactcagataaggtggcttctcttattatccccattttgaaaactgagataaagtacacataatatacagtttaccatcttagccatttttaagtgtacagttcagaagcgttcacactgttgtgcaatcaatctccaacactactttcatcttacaaaactgaaactctatacccatgaaacaacgactccctactccttccttcttccagtccctggcaaccaccatttactttctgcttctgtgagtgtgactactcctgtagtgaaatcagaaaataatttgtcttgtgactggcttatttcactaagcgtagtctcctcaaggtttatccacgttgtagcatgtccttcctttttaaagctgaataatcgtccattgtacgcat

SEQ ID NO: 1826 - DNA, 700 bp, Homo sapiens
tccctactccttccttcttccagtccctggcaaccaccatttactttctgcttctgtgagtgtgactactcctgtagtgaaatcagaaaataatttgtcttgtgactggcttatttcactaagcgtagtctcctcaaggtttatccacgttgtagcatgtccttcctttttaaagctgaataatcgtccattgtacgcatataccacattatgtttatccatttgtctgtggaaggacacttgggttgctttcaccttttgactattgtgaataatgctaccatagacatggtgtacaaatatctctttgaaaccctgtttcaattattttagacatatatccagaattagtattgctggatcatatggtgattctatttttaatttttttagggaccaccacattattttccatagtggctgcaccattttacactcccactaggaatgaacaagggtttcaatttctctacatcctcactaacacttgttattttctgtgtttaaaaacaacaacaacacttttttagaggtggggtcttgccctgtcacccaggctggagtgcagagatatggtcatagctcactgcaacctcaaactcttgggctcaagtgatcctcctgccccagcctcctgagaagctggaactacagtcacatgccctcatgcctggctaattttttatttattttttgtaga

SEQ ID NO: 1827 - DNA, 700 bp, Homo sapiens
tgtttaaaaacaacaacaacacttttttagaggtggggtcttgccctgtcacccaggctggagtgcagagatatggtcatagctcactgcaacctcaaactcttgggctcaagtgatcctcctgccccagcctcctgagaagctggaactacagtcacatgccctcatgcctggctaattttttatttattttttgtagagatggggtcttactatgttgcccagtgctgtcttgaactcctgccccctagcaatcctcctgcctcggcctcccaaagtggatttctgggtgttttttttttctttttgtagtaactatttttaagggtacaaagtggtacctccttatgattttcatttgcatttccctagtgattagtgatgttgagcctcttttcatcgcttgtacccccaatttatagacaaggaaactgaggctttcatcagtgatgtaacctgcctggagtcagccaggtggttggcagtggagtcaaaactggccctctactgagtctgactccagaactctgtgtgctgccgcccctctgggggagagccatccatccatcctgcttaccctggtacttgcttccttccctcctcctcccaaccaccagagcccagttttttgttgttgttgttgtttgtttgtttgttttgagacacagtctggctctgtcacccaggctggagtgctgtg

SEQ ID NO: 1828 - DNA, 700 bp, Homo sapiens
ccctctactgagtctgactccagaactctgtgtgctgccgcccctctgggggagagccatccatccatcctgcttaccctggtacttgcttccttccctcctcctcccaaccaccagagcccagttttttgttgttgttgttgtttgtttgtttgttttgagacacagtctggctctgtcacccaggctggagtgctgtggtgtgatctcagctcactgcaacctccgcctcccaggttgaagtgattctcctgccttagcctcccgagtagctgggactacaggggtgcaccaccactcccagctaatttttgtatttttagtagagacggggtttcaccatgttggccaggctggtctcaaactcctgacctcaagtaatctgcccgcctcagcctctcaaagtactgggattacaggcgtgagccactgtgcccagcccctagttgctttttattttacttccaccactcaaaaaggaagccaggaagggaaaagctgccaaaaaaagcaaatcctggtgcatgtgtgtgaatgtgtgatgatgtacatccttagaggtccctgtgaacagcgtacaacatgagtagctatggacttggaggccagcagctactcacccctcacgccctacagtgaacaaaaccagcgagcaatggaaaagcagacaggtcagcccagctgccagggaaggctgcca

SEQ ID NO: 1829 - DNA, 700 bp, Homo sapiens
gccaaaaaaagcaaatcctggtgcatgtgtgtgaatgtgtgatgatgtacatccttagaggtccctgtgaacagcgtacaacatgagtagctatggacttggaggccagcagctactcacccctcacgccctacagtgaacaaaaccagcgagcaatggaaaagcagacaggtcagcccagctgccagggaaggctgccactcatgggtccagcctccataacaggcactgataacacttccaggaatcgacgcgggatgagctggcccccagtctcagctgctcccaggccatgctgtgggcagggagtgggcaagcactagagcccctgctagggaagcaaatccagagaagcatggccaccttagggcccagggtaggtatggtgccaatgctgggggatccaaaggcagtccctgggctgagcccacttcccacaggtgccacagattcgacaaccaccacgcctggctggccaccattctcttgcagaggagagtttcaaaacttcctcactggtcttcttgtttatcatagcagctagagtgagctctttccaaaagcacgaacctggccttagaatgcttactattttctcactgtcctccgaataaagtcagctcctcagtatacatagaaggccactatgaactagcccttgtggccatttctagtctcatttgtcatatctgtcatccct

SEQ ID NO: 1830 - DNA, 700 bp, Homo sapiens
ttcaaaacttcctcactggtcttcttgtttatcatagcagctagagtgagctctttccaaaagcacgaacctggccttagaatgcttactattttctcactgtcctccgaataaagtcagctcctcagtatacatagaaggccactatgaactagcccttgtggccatttctagtctcatttgtcatatctgtcatcccttgagttccagccactccgatatatgagaattccattacctgaatttcccatactcttgcctagacaggtcttgctcacattttcagaatcagctaaaatcatatcaccccttcttggagtatttcctccacctattgtcccacagagagggtgatttatttatcccaggtcacatagcaagcaaggcaggacttgaatttgggttccagaaccctattgctaaccagggttaatgttagccttctcagtaacacagccagtgtgccccatgggcatctgagggtaggctccacacaccagatgtccacaccttagtgctcagcacaaggccagacacaatgtctgatgaccgctataccgtgctgagggaaagggataagggactagcagaggccactcaggtttttcttgggaggagcatgaggcagaggagggactagcagcagggaaatcctacctgcctgaccaatagcaggcaacagctccatgaggatgctctc

SEQ ID NO: 1831 - DNA, 700 bp, Homo sapiens
atgtccacaccttagtgctcagcacaaggccagacacaatgtctgatgaccgctataccgtgctgagggaaagggataagggactagcagaggccactcaggtttttcttgggaggagcatgaggcagaggagggactagcagcagggaaatcctacctgcctgaccaatagcaggcaacagctccatgaggatgctctcctcagaagaaaggtgtatcctgacccaggtccttaccagatgtgaagcagcaaaagcgggagaagtgtgtgtgcatcctcattcctggaacttagaaaacctgccactaaccacgcagggtgctgaggggctacagcccctgcctgccaactcaccctgtgctcagagaggtccctgagggccagggcttccagctggggtttcgccttctgtgcttccttgcacccaatgagcctcaggaggccatctgctgtcttagagaaactggggcctcaggaaaggaccccaaacctcacaagtatatggtacggcagtacacctcctgatgcctccagaagtctgtggccagggaacagacaagatttggccccgccctgcccagtaacaaggtccctcacacccctcctcccatgcctggcaggaaggtgactcaggcagtgcgtctgggtagcctgggctgcgcttcccccaacgcaacatctaggttcttaggaaacttc

SEQ ID NO: 1832 - DNA, 700 bp, Homo sapiens
atatggtacggcagtacacctcctgatgcctccagaagtctgtggccagggaacagacaagatttggccccgccctgcccagtaacaaggtccctcacacccctcctcccatgcctggcaggaaggtgactcaggcagtgcgtctgggtagcctgggctgcgcttcccccaacgcaacatctaggttcttaggaaacttcatttgttgtgaaaatcggaaatgaaaagacagttggtgacaaactcctttctccatcacctccttattggacagaaacgacccaggaatgcgcctcgcgtgagtcctattctttcttggggtgcacacccgctgctggaagtatgaacagcaggtttgagggggaggggagcgctgacccgggcactgcgcagggagtctcaaggggggctgacgcagagggagggtcaggcactcccgggtcaacggtctcggcctggcacccacctcggtcacgacggtggacaggtagacgtcctggctgaactcccagccatccaggcagctctcctgctccagctgccccaggtccacgtcgcgccccggctccagcccgagcgccgagaagttggcgatggtggcgagccggtagcggctgcagctgtggggcacctcgcggccgtcccgcagccgcagcgggacactgttgttgcgccaggcgctgctcaggttcgcggcgtc

SEQ ID NO: 1833 - DNA, 700 bp, Homo sapiens
ctgaactcccagccatccaggcagctctcctgctccagctgccccaggtccacgtcgcgccccggctccagcccgagcgccgagaagttggcgatggtggcgagccggtagcggctgcagctgtggggcacctcgcggccgtcccgcagccgcagcgggacactgttgttgcgccaggcgctgctcaggttcgcggcgtccggcactcgacagcggtgctccggggtccccgccaggaacacgactgacataccattgaagccattggggatgatgctggcgctgagcaggaagaagatgaggcgctggaagggcccccactcgcccaggaaggcgatcacctcgtcgtagtcccgcatgcttcccactgccgctccgaaacttgcaactacgggtgatgacagcgttctcaggacagtgtcttgtagctggggcgctccccaaggatgttagaacgttcccgggggacaggcaggctgttagaaattggggcgcgaagccggggaccgttcctgggaaacaggctgaaggcgttggagcgttcccgggagctcgcgctgagcttgatgccactgtacacttgggaccacacccccatccccggccgggcgcggggaaggggagggcggcccagcccgggaggctgggctcccggctgtctccgccctgtgcttcgcgcgcccgcccgcccccaaggacc

SEQ ID NO: 1834 - DNA, 700 bp, Homo sapiens
cggggaccgttcctgggaaacaggctgaaggcgttggagcgttcccgggagctcgcgctgagcttgatgccactgtacacttgggaccacacccccatccccggccgggcgcggggaaggggagggcggcccagcccgggaggctgggctcccggctgtctccgccctgtgcttcgcgcgcccgcccgcccccaaggacctgacgggggcttccaggctgggctcagccattccgcccgcgtgccggggaagaagctcgttctcggttgtccccagccacccccgagcgctgattcccagacctgggccccacgtgggagggcgggcgcaagggaggagccgaggccagagagcgagttctcggaggggtcggccctcgatctgctcgggccgcgtggccccgggcccagaccccagcagggttccctccgcggtctcctccaatctggaggctgagcttaggctgccacgcgtggggcgcggaggggcgagtcagtggagtcggttcccgggaaacttctgggggcggcagagcgacaggagcgcgccctctcctgtggcgcctcgcgcaggcggctggcacacgccgacagggagctcatttcccaacagtcctagcagagctgaattcggtcacccctggcggcgcccggacagcgtcctcaggacagccaggaccctcatcttgcacagggaaaac

SEQ ID NO: 1835 - DNA, 700 bp, Homo sapiens
gtcggttcccgggaaacttctgggggcggcagagcgacaggagcgcgccctctcctgtggcgcctcgcgcaggcggctggcacacgccgacagggagctcatttcccaacagtcctagcagagctgaattcggtcacccctggcggcgcccggacagcgtcctcaggacagccaggaccctcatcttgcacagggaaaacaggcccacagcctggaagggatgagcaaggtcacactacgtcagagatgggcccggatcggagggaggggcgggggcaggagacaaccgagtgcccgggaggcgagtttcctcccccgcacgccggcgtaatggctgagcccagcctggaagcccccgccgggtccatgggcgggcgggcgccaggacatggagcctgcgcattgcgggagcacagtcatggaggcactgtcgtcacgctgggttctgattttgagccccttgctctcctcacgcccccagggccctttatcgcggcaggctgtcagagctttctccgactggaaggctttctgttagcagaagggcctgcccccagtccaggaacagagggagggagggagagagaagtaggagatccgatttggcgctcagacccggcagggtaaccaaagcagggaccacagcctccctttttttggctcagtgcccagacctaaggcccttctgctgttgtgtgag

SEQ ID NO: 1836 - DNA, 700 bp, Homo sapiens
ctgtcagagctttctccgactggaaggctttctgttagcagaagggcctgcccccagtccaggaacagagggagggagggagagagaagtaggagatccgatttggcgctcagacccggcagggtaaccaaagcagggaccacagcctccctttttttggctcagtgcccagacctaaggcccttctgctgttgtgtgagctagcccgggcctggagcctgagccctggggttcacgaggcagataaaattgacagggtgaagagctcacctctttggagattttgcacgagtgtgtttgtttccccaggctccgattaagaggcggagggacatttctgcctctttttgtgtagcttccagtctgacccctcctcttaggaggacttcccacccccttggaacctcagtttcctacctgtaataagactatacatcctgatgtgctaggacagctctgatttatgcctattaatccagtgaaattattaatagagcctccctttactttcacaagtatccttcttcgaatgatatattatggtcattatcttacttagcttgggtttcatctccctactccaccccatataatagagcaaagttggagacaagaacgtatataaggtcgtttattctgagtaatgataccataaaacagaagtgagggactagggaggagagtgaacagagagggaggt

SEQ ID NO: 1837 - DNA, 700 bp, Homo sapiens
cctttactttcacaagtatccttcttcgaatgatatattatggtcattatcttacttagcttgggtttcatctccctactccaccccatataatagagcaaagttggagacaagaacgtatataaggtcgtttattctgagtaatgataccataaaacagaagtgagggactagggaggagagtgaacagagagggaggtaaagccaacatagactgtgaaattgagatggttattggcgatgaccaagatcagtaacagtgttgtgtggagccctagtggagcctaagaataaatggaaaattagcaatactgagcctgtctttattgaaaattttgatattgcgttcatcatgggtatttgcattaatttctattttaaaaaatattgcattaaaatataattaatcttggttactgaatttcttggtgcctccttaaatttgcaccagagacaagtgccttgctctttttcctcacctcagccttgtctcaatccccattgctgtgggttactgaggtttaatcccactgggggcttctaaagagccatatagaatgaggaggtatttgtttcctagttctgtctccattggtcaactgcttgcacttccagattagcacataagtgagggctgaacaggtaccactcgactatttgccattgctcacaagtgtatgtaaatctctatctggaattg

SEQ ID NO: 1838 - DNA, 700 bp, Homo sapiens
attgctgtgggttactgaggtttaatcccactgggggcttctaaagagccatatagaatgaggaggtatttgtttcctagttctgtctccattggtcaactgcttgcacttccagattagcacataagtgagggctgaacaggtaccactcgactatttgccattgctcacaagtgtatgtaaatctctatctggaattgttttgtcctccatacaaaatgaatgaacaagtatactgcttacagcttagcccactgggggaatttcccttcaaagttgtttagggctaccccctaaatggagctatgttacaggaacaatctctttttctttttttcttttttaactagtatcaatgtctaaagctaatccatctgtgagtaagggctattttcccctccatcagttggttacagagaactacctactaaggctgtaggtctgagctaagacagaagggttggtatagccgatagctgaggtaggtgtcataggagtctgagccaccttttgttgacttacatgcaccctattgacctgcttagtcctgatcctgaatttaccattcctgttctattattatatgatggattgctgataagtctgcttttttttttttttttttttttttttgagagagattctcagtctgtcacccaggctggagtgcagtggcacaatcacagctcactgcagcctc

SEQ ID NO: 1839 - DNA, 700 bp, Homo sapiens
gagccaccttttgttgacttacatgcaccctattgacctgcttagtcctgatcctgaatttaccattcctgttctattattatatgatggattgctgataagtctgcttttttttttttttttttttttttttgagagagattctcagtctgtcacccaggctggagtgcagtggcacaatcacagctcactgcagcctcaacctccctaggctcaagcaatccttctacttcagcctcccaggttgctgggactacaggcaaacacctccacacccagctaatttttttttctttattttttagagatggggttttgccatgttgcctcctgggctcaagtaattctctgccctcagcttcctcccaaagtgccgggattacaggtgtgagccaccatgcctggcttaaacctgcctaatcttacgacttggtagactctgacaatacctggcttacaatgggtatctctggttgcatagacccttgatgtcccattgctaggctcttggtttttattggggccaaacagctgcttttcaaaagtcgaatatctctctgctgcatggccttgctccagaactttagagatctgtgctgaaactcttttattagggcatgtcagagactctgccctgtagccttattcatcatgtatgcctctagccccattgtatctgctggataatatgaaccaaatg

SEQ ID NO: 1840 - DNA, 700 bp, Homo sapiens
taggctcttggtttttattggggccaaacagctgcttttcaaaagtcgaatatctctctgctgcatggccttgctccagaactttagagatctgtgctgaaactcttttattagggcatgtcagagactctgccctgtagccttattcatcatgtatgcctctagccccattgtatctgctggataatatgaaccaaatggtagagaagcttgtactctagttggacacactgtacagctctctcctgctctgggtttcacccgaaactgaaagccttcaggggcacgaaatagatgggtcagaggaatactccaccaagcactatgccttagtgttggaggatacagagctcaataacttgtctttactttacaggggataacctggcatgactactgatccctgataactttacccatttgtttcaaaataatatgggatagaagaagttggtggggatatagatgaaataatatgggctgtgaatagtggttcaagggattcgttttactagtttgtctacttttacatccatttaacttattctagaacaaaaaagtaagaaaaaagttgaacaatatgaatgtcctgaatcttcatatttttatctgctatcctttggcatacatgtgtctttactaggacatctagagttcttgcttcttcttgcttactaggtcaaattagcattaggtcatc

SEQ ID NO: 1841 - DNA, 700 bp, Homo sapiens
gattcgttttactagtttgtctacttttacatccatttaacttattctagaacaaaaaagtaagaaaaaagttgaacaatatgaatgtcctgaatcttcatatttttatctgctatcctttggcatacatgtgtctttactaggacatctagagttcttgcttcttcttgcttactaggtcaaattagcattaggtcatcaatacagtggactaccatgatgttcaatggaatattgagacaatcaaagtcgctagatactgtgttgtgcagagaggagaactaacatagcccagaggcaagagagtgaatatgtactgctattattcctacataaaagcaaacagtttttcatcctcctgactgaaggatattgagaagaaaatatttgatgttgaaattaatctctgcaataccacccaggatgtggttttacttctcatttaataaatcagtaagaaaggtgagggtaagtgtcaggggctttcatttggcccttcctaccttaatggctcttaataaaatagggagtaaatgttagtgtactgccagttgctacaacatctgtcctagttatttacttagggataaggaaattagtacagtgtggatcttcagacttctggatctgtttgcaagagtactccatttacctggctttcatgagcctctgtcacggggggaccatgatagtgtttccc

SEQ ID NO: 1842 - DNA, 700 bp, Homo sapiens
taccttaatggctcttaataaaatagggagtaaatgttagtgtactgccagttgctacaacatctgtcctagttatttacttagggataaggaaattagtacagtgtggatcttcagacttctggatctgtttgcaagagtactccatttacctggctttcatgagcctctgtcacggggggaccatgatagtgtttccccccagcactgatgccagctcatactctgtacccaatagcctttgaaagtctggttctttttcttccccctgaccagagttactatgataaatggccacagatctctcatgtggaaagattggggaaataattatcttgtatacctttggcagcattggagggctcttctataaaaaggcttggcctttccttaaatcaataggctctgagcctgagaactggcctagatcaaggaaatttatgaggaaatactattttccattatggcagctgtcatctgccttctgctcatgagcccttgattttggggattgctgttgttacagtcaagtaatacacagtcatctgccaatttagttaactctagggacactatggtctattagccattgccatagatagaccctatgggtcaaagcacttagctgccactttggttttgtggtaattattattattattatttttagacggagtctcactctgttgcccaggttgga

SEQ ID NO: 1843 - DNA, 700 bp, Homo sapiens
gattttggggattgctgttgttacagtcaagtaatacacagtcatctgccaatttagttaactctagggacactatggtctattagccattgccatagatagaccctatgggtcaaagcacttagctgccactttggttttgtggtaattattattattattatttttagacggagtctcactctgttgcccaggttggagtgcagtggtgcgatctcagctcactgcaagctccgcctcccaggttcacgccattctcctgcctcagcctcctgagtagctgggactacaggcacctgcgaccatgtccggctaattttttgtatttttagtagagatggggtttcaccgtgttagccaggatggtctcgatctcctgacctcgtgatccaaccgccttggcctcccaaagtgctgggattacaggcgtgagccaccgcgcctggccattttgtgataatttttatatctaccctgcctctgttgattgttacccatctggtctctgcaattccagggtcctaccatccccactgacactaagaattcctcacctttacatgttgtgttgcctcggtgaaaagagtggcctctggacttcccatgggaatgtagtcttctagtaggttctctgatcttgcataataactacaatctaacatgctaatccctctgagacttctgactccttcagtattct

SEQ ID NO: 1844 - DNA, 700 bp, Homo sapiens
ggtctctgcaattccagggtcctaccatccccactgacactaagaattcctcacctttacatgttgtgttgcctcggtgaaaagagtggcctctggacttcccatgggaatgtagtcttctagtaggttctctgatcttgcataataactacaatctaacatgctaatccctctgagacttctgactccttcagtattctgccaaggaagtttctggcatctctacttcatttccgaaggtcgtaattgtgtccaagtttcaaagaagcatctcagaagcatgtgaaaatggttttatgtatccttgattggatgttaatccctgaataatgagagtgcccccagattgatacattcttacaaccctctcctcacacccctgttatccctgttcctgccacaacataggtcccgtaattttttcaatgtgtatgctatttgcttataaatcagatactgtatttctccacttaggctgtgctgagacctaaccctagttattggtctgcaggcaatgaagggaggtaggggatatggaggagaataagcatcatcgttggggcccttgccttaggaggagtcttggcaggattccaggcaaggagaggcttgtctcctatagcaggagaaagatagctgcttctgctggccttgaaggtttaggagaatccaggaattcaaaattctcacattaatctat

SEQ ID NO: 1845 - DNA, 700 bp, Homo sapiens
  misc_feature (1)...(700): n = A,T,C or G
ttggtctgcaggcaatgaagggaggtaggggatatggaggagaataagcatcatcgttggggcccttgccttaggaggagtcttggcaggattccaggcaaggagaggcttgtctcctatagcaggagaaagatagctgcttctgctggccttgaaggtttaggagaatccaggaattcaaaattctcacattaatctattcaaatgttcccattctttgttccagggttccatatgtttcctatcagggccatgactccattgtagaaagtagagctatcacagctgtgaatcccttccttgcaggtctgccttctaggaccactcttatgtcgactgtcttagcccagatttcctcctgaaagcaaagcctgagtcaagagtttgtgtgtaggtgatttatttgggaatggatccaaaggaacaggaataagtgactggggagagtaaaacaggaaagaagggaagccaatataagagtgcagaggccagatgtggtggctcacacctgtaatcctagcactttgggaggccgaggtgggtggatcatgaaatgaggagttcaagaccagcctggccaagatggtgaaaccccnnctnnctactaaaaatacaaaaattagccangcgtggtggcacacacctntaatcccagctactngggaggctgagncagnanaattgcttnaacccnnggagg

SEQ ID NO: 1846 - DNA, 700 bp, Homo sapiens
  misc_feature (1)...(700): n = A,T,C or G
gctcacacctgtaatcctagcactttgggaggccgaggtgggtggatcatgaaatgaggagttcaagaccagcctggccaagatggtgaaaccccnnctnnctactaaaaatacaaaaattagccangcgtggtggcacacacctntaatcccagctactngggaggctgagncagnanaattgcttnaacccnnggaggcagaggttgcaatgagccaagatcgcgccactgcactccagcctgggcgacagagcgagactccgtctcaaaaaaaaaaaaaaaagtgcagagtctcagaccagcccgaagagctgcagccgccttttgcgccctccctgccttccccatcctccctgccgacatcatgctccagttcctgcttgaatttactttggcaatgtgattggaatgtatctggctcagaactatgccacgccaaacctggataaaacacttgatgaaatgaaaaagggcaatgccgagaaaacccccctagttcatgaggccgactccagcactgccttctggatacactgattgcaccactcttgagggcctcctttaccatctcaaccaaaggcttttgttttcatctccaacctcagcgattttcgtcttggctagacccggtgctgccttaggacaaaaatagggccacaagttaagaactacctatgtagtgtgacagatcccctgcc

SEQ ID NO: 1847 - DNA, 700 bp, Homo sapiens
catgaggccgactccagcactgccttctggatacactgattgcaccactcttgagggcctcctttaccatctcaaccaaaggcttttgttttcatctccaacctcagcgattttcgtcttggctagacccggtgctgccttaggacaaaaatagggccacaagttaagaactacctatgtagtgtgacagatcccctgccaggttgtttaagggtacatgtccactgcctgaaccctgaaggccaggcaatgagccaaggccatggtgtatagctgaggaataggtgtccctgggaacccaaacatcctggagaatagctgagaacctaccaagggaaacagtcccatcacacacacatagtaggtaaagagacagaaaattagcttagagatgggaggtggcacggatctctaaagctgtcccgctgccattcaggagtgcctcatgcataagtcctaataaactcatctactagccaagctgaacttgtcccagacatgcttggtctctttgctccctcccagtttggggtaaggttttttttaaatacaattccaggtttttctcattacaattgctgtcatgagcaggatctgagaaaccaatggatgaattaggaaggcgcatctgcggggagaatcctagggtggttggcaacatgcatgtggcgtggagttgcccgactgctcaatcttcaca

SEQ ID NO: 1848 - DNA, 700 bp, Homo sapiens
gcttggtctctttgctccctcccagtttggggtaaggttttttttaaatacaattccaggtttttctcattacaattgctgtcatgagcaggatctgagaaaccaatggatgaattaggaaggcgcatctgcggggagaatcctagggtggttggcaacatgcatgtggcgtggagttgcccgactgctcaatcttcacaggccaccgtggactctgggaaaacactggcagaaactgaatcacctattgtaagaagttaagatattaaaatacgataaagataataaatgtgctattgttgcaataagggtagctactgagaaatcatgagagcaggaaagggagaaagggtaaaaactcctgcagaaggtgaaaggcatgccaggttttctaggacaccagcaggttacatatgatggcctattcttgtgcacgttctaaaactgatgggcaaataacaacaacaacaaaaaaaaagagctcaaatggttaagctgcaactatagagttaaatagcatcttcatatgctctctgtttctctctttcttttcccacatgctttgaatctgctgttattaagccaccgtgttgagataaaactcactgtttatggtaacactaattcaaggttatttggagattttgtttttcttatacaattaagccagttctagttaaaatgtaaacaataaaatgaa

SEQ ID NO: 1849 - DNA, 700 bp, Homo sapiens
actatagagttaaatagcatcttcatatgctctctgtttctctctttcttttcccacatgctttgaatctgctgttattaagccaccgtgttgagataaaactcactgtttatggtaacactaattcaaggttatttggagattttgtttttcttatacaattaagccagttctagttaaaatgtaaacaataaaatgaaaacgaaaaggaaaaaagaggtttttaaaaatcaaactgccatggaaacttctttcccccaaattttgatccacagctttccttggattacctatcagggaaaatagagcttagccataacaggtcccaattttgtcaaaagtaatttgggtccaactgtcttttgtaaaaacaacaaatttattatattgtctcatggctagagttctgaagtaaaattatcagatctttgtgtatgtatgtatatacatgtttaaatatattatatatgtgcatgtattatatgttctaacatgctaccaaataaaattatagataaatgggtataaagtccaaatgcttttcaagttcacaggaattcaataatctttgctaaataagttggcttttaaattattagtaaataaaaataaagatatcttcaaaagtgtcagcatacatttttgtctgagtcttctgataaaatacactttatatttgcctctgctagatactttaaag

SEQ ID NO: 1850 - DNA, 700 bp, Homo sapiens
aaataaaattatagataaatgggtataaagtccaaatgcttttcaagttcacaggaattcaataatctttgctaaataagttggcttttaaattattagtaaataaaaataaagatatcttcaaaagtgtcagcatacatttttgtctgagtcttctgataaaatacactttatatttgcctctgctagatactttaaagggtcagggttttacatgaaagttagaagactgtaaacccagccaaaaataaaatgatctttgtctgtatgatttttttgataagcaagactaattcgatattgttggtttaatgaaaacaactgaattttctgagttatcagcaggaatccccatgtgtttaactttaaggctcttgcttagatgaacacctgatattcacaagctatgaaaatggttaacagggaaataacttgcaatgacgattagctttgttgactgtcttggttctcacaagtaatctagataaactgctaaaaatgaataaactgagtacatgtaaatgagataaatgtgtgtaggtgaaaattctgtatagtttaaaatcttaaaattactttaggtactcattgaatgtctaggtcatttccagtttaaaaagggttatgatatgggcgaggtatttgtggaccttaatgagctagataaaaacaaggactgggccgggcgcggtggctcacg

SEQ ID NO: 1851 - DNA, 700 bp, Homo sapiens
gaataaactgagtacatgtaaatgagataaatgtgtgtaggtgaaaattctgtatagtttaaaatcttaaaattactttaggtactcattgaatgtctaggtcatttccagtttaaaaagggttatgatatgggcgaggtatttgtggaccttaatgagctagataaaaacaaggactgggccgggcgcggtggctcacgcctgtaatcccagcactttgggaggccgaggcaggcggatcacgaggtcaagagatccagaccatcctggccaacatggtgaacccccgtctctactaataatacaaaaattagctggacgtggtggcgcgtgcctgtagtcccagctactcaggaggctgaggcaagaaaagctcttgaacttgggaggcagaggttgcagtgagccgaaatcatgccactgcactccagcctggcgacagagtgagactctgttgcaaaacgaggaccaagtccaggaaataatcaaagaacaaaaaggggatgagccaattgaatgtacacttgccctggtataggcaggcaattaacacgaaaaaataccacctgccagggggatgctttgaaatcacctgaacaatccaggaattacataaggcacaaatagtccagagcacctataacagccctatgtggcctgcaaagaagccatatgatacctagaaaatgacagtaaactg

SEQ ID NO: 1852 - DNA, 700 bp, Homo sapiens
gggatgagccaattgaatgtacacttgccctggtataggcaggcaattaacacgaaaaaataccacctgccagggggatgctttgaaatcacctgaacaatccaggaattacataaggcacaaatagtccagagcacctataacagccctatgtggcctgcaaagaagccatatgatacctagaaaatgacagtaaactgccgtgagctaaacagagtgatgccccccgtacctgcagctgtacccggtattgctcagctgctagagcaaatggtccttaagctgggaaatgtccatgctgtgattaatttggctaatgccttttaaagtatttctttagcagacgattcacaggagcagtttgcattcatttgggagggcaaacaatggattttccaggtgctaccacaagaatatctgtgcagccccaccgtctttcatgatatgattgcacaggacctgtctagattcttgcctacctcagtcttcctgttttaccatactgataatataatgttaacctcagaatctcttacaaatctggagactgccctgcacaccatcttagacagcctaaaaaggacagggaatgggaagtcaacccccaaaacatacaagggcccagtgtagccatcaaattcctaggaattacctggatgggtaagacacgaaacatacccagagctgttattgataagat

SEQ ID NO: 1853 - DNA, 700 bp, Homo sapiens
tactgataatataatgttaacctcagaatctcttacaaatctggagactgccctgcacaccatcttagacagcctaaaaaggacagggaatgggaagtcaacccccaaaacatacaagggcccagtgtagccatcaaattcctaggaattacctggatgggtaagacacgaaacatacccagagctgttattgataagatagcacagtagcctattcctcagacaataaagcaacttcacgttttcctaggtttattaggctactggaaaatattcatctctcatttgacacaaaccctctggccttcacacaccctagtaaaaagggatgcaaaatgggactggacacataaagagcaagaggcatttgacaaagcaaaaatgttggtaaaacaagcccaagcattaggtgccccacagccacagcacccttttgcattagaagtcactagagataccgcagggatgaaatggtgtttgtggcaaaagcaaccaacagtaatggtacttgtaagatttggtctcaattatggaagggggcataatcccactatatagtcctggagcaataactctggctgtatatagggcattgcaacaaatggaggccatcaccagaaagcaaaccatcacaataaaaacttcctctcctataaaaggggagatggagggccttctagccaagcccatctctgggatg

SEQ ID NO: 1854 - DNA, 700 bp, Homo sapiens
aatggtacttgtaagatttggtctcaattatggaagggggcataatcccactatatagtcctggagcaataactctggctgtatatagggcattgcaacaaatggaggccatcaccagaaagcaaaccatcacaataaaaacttcctctcctataaaaggggagatggagggccttctagccaagcccatctctgggatgatacaatcacacactgctgaagtggcatgcctatctacaacagaaggtgtcttgtccatgagtcctgtaagtcaggcaccacagaaaatgctcagacccatccactttgaacaagtggaaggggccgacatggcaatgaatctacctactaggccaaccatcatatatgaagggattccattgatacccactagggcctaatacactgatgggtctagcaaaggcacccaacaccaatggttggcaatcatggtgaatatggacactgacaacatatggttagaatgggaattaggacaaagcagtcaatgggccatgctacaggcagtttggatactcatcacccacaagccctggccattagtcatttgcacagataattggactacatacagaggccttaccatgtggatcaatcagagtgccacagacaattggcaagtttggggcaggatcctctggggaatgaccatgtggcaagacatccacatcaggttaca

SEQ ID NO: 1855 - DNA, 700 bp, Homo sapiens
agcagtcaatgggccatgctacaggcagtttggatactcatcacccacaagccctggccattagtcatttgcacagataattggactacatacagaggccttaccatgtggatcaatcagagtgccacagacaattggcaagtttggggcaggatcctctggggaatgaccatgtggcaagacatccacatcaggttacaggaaagggatgtccatcttgtgatgtaccatatggatgcacatagcccaaacaaccttctggaaatcaaaaggcgaatggccttactcattcacgtgcaggcaatttgcccaagcccatccgaggaaatgccgtatgtgcacatcataaaaacggccaccaggggcaatcacagagtggcccatagcaaaagcagcaggcatccctatccaataagcaaatgttttggcagctgttcagaaccatgagatctgctcacaactgtgacctagaaagattccctccacaccaggtcacatacattgagccatacaaactatgtgagcctggcaagtcaattgtattggtcccctgccccagaatagaaagaaaaggtatgccttaacttgtatggacacaacggggctgctacaggccttcccaataaaatgtgccactcaactggagatcatcaaatgtctcactgctcttttgtgtgtgtgtgtgtgagacagaatcttg

SEQ ID NO: 1856 - DNA, 700 bp, Homo sapiens
attgagccatacaaactatgtgagcctggcaagtcaattgtattggtcccctgccccagaatagaaagaaaaggtatgccttaacttgtatggacacaacggggctgctacaggccttcccaataaaatgtgccactcaactggagatcatcaaatgtctcactgctcttttgtgtgtgtgtgtgtgagacagaatcttgctctgtcccccaggctggggtgcagtggtgcgatcttggctcactgcaacctccgcctctcaagtagctgggatcacaggtgcccacctgtaatacaaaaacgcctggctaatttttatatttttaggagagatgggttttcaccatgttggccaggttggtctcgaactcctgacctcaagtgatccacccacctcagcctcccaaagtgctgggattacaagcgtgagctaccatgcctggacctcactgctcttaacgtcatgtatggcataccaaaaaggatagataatgatcaaggccccaattcacaggccataatattaaacactgggcatcagaacaaaacatagactgaaagttccacttaccatataacccaacaggggcaggccttacatgcattgtcttaggactggactaagaatctccctgtaatacaaattttaaatgtcacccactaccatgcatggcatcacttcctgtgaatggttggcaag

SEQ ID NO: 1857 - DNA, 700 bp, Homo sapiens
gccccaattcacaggccataatattaaacactgggcatcagaacaaaacatagactgaaagttccacttaccatataacccaacaggggcaggccttacatgcattgtcttaggactggactaagaatctccctgtaatacaaattttaaatgtcacccactaccatgcatggcatcacttcctgtgaatggttggcaaggtttgtaaaccaggccccacaaactcttggggttacctctgagactcagatccatgatcctgaaacaaatggccagactttgcccctgagcacatcagtggatctaccaagtggcgatggctacatggacccaaagttgagctggaaaatgcccccatactagatcgattttatagcgctggaggacaccatgaagactgactgaggggaaatggtcccagccgtgctccctgatggagatccgagatactgacgttatcaacatgcagcaacaccaacacctgctagatgcgttaaatgtggatagcacaggcaaggccagaaatttaccaattggctttatgcccacccctgtggagggaaaccctatatagtactgtaagccaggctcgaggcccagggcatctgccctaatagggccaatgggaaaaatgattatgttagcaataattaagttacaaggaatagatatacctatgagggtttctactaaacgcctg

SEQ ID NO: 1858 - DNA, 700 bp, Homo sapiens
  misc_feature (1)...(700): n = A,T,C or G
tggatagcacaggcaaggccagaaatttaccaattggctttatgcccacccctgtggagggaaaccctatatagtactgtaagccaggctcgaggcccagggcatctgccctaatagggccaatgggaaaaatgattatgttagcaataattaagttacaaggaatagatatacctatgagggtttctactaaacgcctgtgtttatgcccaaaggccatggcttctgctacccatggtagntagtaatgtcttcctggactgggctgcagctgcagcaacagtcaacaaccagccctgttactgggtatagggatacctccccctgtcaaatgataatggcatgccttggaatattctgcctttctcccaacagaactggaatgattgcttcaacagcatcaataaggcaatccggctcactggggactgcctccacctggaggccaaattgccaacatgacagagaccaaacaacatacgtcctcataggcactacctgttatttctctgataaagagaatcatgtcacagatgctttaaatcatttgtcaactcagatccatgatatagttcaattaggttactttgactcattcttaaattaggtacacagcttacctacttgctggaattatgttttgctaataggcatcataattataganagcttctgctttttatgctcttatgtataccat

SEQ ID NO: 1859 - DNA, 700 bp, Homo sapiens
  misc_feature (1)...(700): n = A,T,C or G
gttatttctctgataaagagaatcatgtcacagatgctttaaatcatttgtcaactcagatccatgatatagttcaattaggttactttgactcattcttaaattaggtacacagcttacctacttgctggaattatgttttgctaataggcatcataattataganagcttctgctttttatgctcttatgtataccatggaagtggcctgtatccacaaactgtggntatacattatagacctctatagctcttcccctcgtttcctgctcagggactctcgagcaaggttggtggaaagaatataagagctggggaatgggatgaattgaagtatgacaggttccccggccaggtgactcaagggtgtatgtccgctgcctgaactctgaagatcaggtgatgacccaaggccatggtacccagccaaggagcaaatgaccctgaggacccaaacatcccagagaatagctgagaacctaccaagggaaagagtcccatcacacacacagaagaagcaaagagccagaaaattagcttaaaagcagcttagggatgggaggtggcacagatctctaaagctgtcccactgccatccaggaatgccttgtgtgtaagtcctcataaactcatttgcttaccaagctggacttgtctgaggcactctttggtctcttggctccctctcaatttgggaga

SEQ ID NO: 1860 - DNA, 700 bp, Homo sapiens
atcacacacacagaagaagcaaagagccagaaaattagcttaaaagcagcttagggatgggaggtggcacagatctctaaagctgtcccactgccatccaggaatgccttgtgtgtaagtcctcataaactcatttgcttaccaagctggacttgtctgaggcactctttggtctcttggctccctctcaatttgggagaaggtattttttttaatacaattttgggtttttcttgttacattacccttatatttccgacatccttatctctttccacatcttcctttcagccgtttgggaggttctaagactggaattacggtgctagattagtgaacatgacctttaatgagtagtctttcccttattctttgggattttgactaccttttgtcagatgaaaaattggtgagttttgtgtagctgattggatgcaaataatgctgatttcacattttagcaaagatgcttgttaaacatttggtacgaaattgtgttgtttctaagtaattaaaatctatttagaagccaaagaagaagaagaggaagaggaaagaagaagaagaggaagaggaagaagaagaagaagaagaagaagaagaagaagaagaagaagaagaagaagaagaaaagaagaagaagaagaagaggaagaagaagaagaatgcagcagtaggttgtttacagatgtaagaaatt

SEQ ID NO: 1861 - DNA, 700 bp, Homo sapiens
tttctaagtaattaaaatctatttagaagccaaagaagaagaagaggaagaggaaagaagaagaagaggaagaggaagaagaagaagaagaagaagaagaagaagaagaagaagaagaagaagaagaagaaaagaagaagaagaagaagaggaagaagaagaagaatgcagcagtaggttgtttacagatgtaagaaatttgggtatgggtctcagaaatgtccatctttaaggttcagaagtagggaatatttaggtctgggctggagatacctatttgggagtggtcataactgcagagttcctgaggcccttgttgtgacagcagagccagccagggttcctggttgcaagcatgctcacagaattgatgggaaagctgaggtactgctgagataagcagaaatcagctgttggagatggcacccgcctgggaagtagacagaccagagtggagccctaacagggcagcctgcttcagactgagcctgaaggggaggagtggctccttgactgggccaggtggcctctgatcactgtcctcccagaacaagtccagtgtggctggagtaagagcacaaaaggagggtagggacagtttagaagggatgtggttattagacagcgcaaacagcacaaacaaccctagacaatgagcatctggggaggaatggaggagctaggacagggccttgaggag

SEQ ID NO: 1862 - DNA, 700 bp, Homo sapiens
agtggctccttgactgggccaggtggcctctgatcactgtcctcccagaacaagtccagtgtggctggagtaagagcacaaaaggagggtagggacagtttagaagggatgtggttattagacagcgcaaacagcacaaacaaccctagacaatgagcatctggggaggaatggaggagctaggacagggccttgaggagtggtgcctcaggggcaggcaagagagtggacaggaacactggctgggaaggcacagggtgacaggactgaggagaaagagacttcttccacccagaaatctctttctgggtggtgagacagtctccagcaattggagagagagccctgggggctgggaaggggccagtccaggctgtctctcagcaggctcctggaaccacggagggtcagtgagtggtggggatgacccatttagccgggatcatgaccagacgagtgagtcaagcaggcatggtggtaggttcatgcatatcagagttggtgatcaggtgctgtggcaccagccttgtccacactcagatccaaagcttcaggggtcacctttactttgcccagcttccaccattccatgccccatgcaaaaagttggtaaggttgagcctgcactctgggctgttctggggaccttgccaagtggaaacagatcagcacccttcagaaatggcttggtcagagtcac

SEQ ID NO: 1863 - DNA, 700 bp, Homo sapiens
ggtgatcaggtgctgtggcaccagccttgtccacactcagatccaaagcttcaggggtcacctttactttgcccagcttccaccattccatgccccatgcaaaaagttggtaaggttgagcctgcactctgggctgttctggggaccttgccaagtggaaacagatcagcacccttcagaaatggcttggtcagagtcactaaaccattggtaggcaggcaacactctccatggaagactggtatgcgccgttactttggttgcccctgccatggagatttgctagggtgtgtgtgaccttggcaagttttttaacctttctgagctcatccataaaatggggataataaccatacttcctttctggttggtatgaggattaaaaacaatcatatcgttcactaagggcttggagatgaaggcctgggacacattagctcccataatagttattatccaactcccttcccttcttctgagactgtgggtgtgctccagcttcccatgaaaattcaattacagaccaagaacaccctggatggcagctgagtgttcttgcactgcagccattgtcagtgaagctggtgtgtgtgtgcgtgtgtgtgtgtgtgtgtgtgcgcgcgcgcgcgcgtgggtgtcgggggtggtgcatcagcctctgagcttggctcaccgggcctgacagacccacttaagggct

SEQ ID NO: 1864 - DNA, 700 bp, Homo sapiens
tcccatgaaaattcaattacagaccaagaacaccctggatggcagctgagtgttcttgcactgcagccattgtcagtgaagctggtgtgtgtgtgcgtgtgtgtgtgtgtgtgtgtgcgcgcgcgcgcgcgtgggtgtcgggggtggtgcatcagcctctgagcttggctcaccgggcctgacagacccacttaagggctggttaatgcggtttctgagcccacatggctgagaccgactccagaccctgcaggacccagtgaggtctctagcagtctctcctgggatttctagtctctgcattccagccacaaatggatgtatgtcagacactagcaaagttgagggttggtttctgtagggaccctaatagtttcccacttgtggtagaggggacacaggaggacagtgcttgcttattagagaaacctcttcactacccttaaacctttttagaggttccacctccattcagatgtgctgtgggaatgttgttagaaagacagattattctgtgagaaaatgataaaccaggaagttacatgaaaagcaagtcaggggtcggcctggggtgcaagacaagaagttgggtaagaatgagttgtccaggatagcactggagtgcacgtagctggacaggggcacccagaggtggaggggaggtggggcactccccaggtggggcagagggactcagggc

SEQ ID NO: 1865 - DNA, 700 bp, Homo sapiens
agacagattattctgtgagaaaatgataaaccaggaagttacatgaaaagcaagtcaggggtcggcctggggtgcaagacaagaagttgggtaagaatgagttgtccaggatagcactggagtgcacgtagctggacaggggcacccagaggtggaggggaggtggggcactccccaggtggggcagagggactcagggcccacagcccaggcttctgggcatcatggtgtggtgcaagtcacaacactgctcccacccatccaactcagcagttcaagggctgtgagcccagggccaagctagcacaccccctagaggggctgagtccttggccatgaagggagggctggcttgaagctgcatctgggctccgcctaccttcacccctttctttggttctctaggaggaaagtatcaaataacaaagcttgtcactcagagaaccagaaaggactccatttgtgtttcaacctccttggagggtcaaggaagcctgcaagagtcttgaggagagtttgatggggctgaacttacagataagcacaatgagagttacagaggcacaagttgtccacagaggccagcaggggctgtgtacctcatgtggccctgtgagctgggatttggaatttagactctgtcctaagagcagtgaggagccatggaaactataataggcaagattgacagggaattgca

SEQ ID NO: 1866 - DNA, 700 bp, Homo sapiens
gagtcttgaggagagtttgatggggctgaacttacagataagcacaatgagagttacagaggcacaagttgtccacagaggccagcaggggctgtgtacctcatgtggccctgtgagctgggatttggaatttagactctgtcctaagagcagtgaggagccatggaaactataataggcaagattgacagggaattgcacttgaaaaacctcctttagctgttatgtagagaaaggattgagggaggggccaggcaggagacagggagacaaggcagaggcccttacactgttcagcatgagacagtggcgtctggactggggagagtgggctagtttggaattagttagggatgaacgcagtcatgcttgctaactggttttactgcgtctacctttgccccttagggcctattctccatacagcagacaatgtgatcctagttaaaacataattccaggtcatgccgctcctctggcttttcatctcagagtaaaagtcaaagtccttaccatggctgtaggagaacagcctgttgcgtggcaagaatgatgcttttttttttttttttaacagggtctcactctgttgcctaggctcgagtgcagtggcaagatcatagctcactgcagcctcgaactcctgggctcaaggggtcctcccacctcagccttctgagtagtttggactataggtgca

SEQ ID NO: 1867 - DNA, 700 bp, Homo sapiens
tcaaagtccttaccatggctgtaggagaacagcctgttgcgtggcaagaatgatgcttttttttttttttttaacagggtctcactctgttgcctaggctcgagtgcagtggcaagatcatagctcactgcagcctcgaactcctgggctcaaggggtcctcccacctcagccttctgagtagtttggactataggtgcatgccgccacagctggctattttttttttcatttttattttttctagagggggggtctcgctatgttgcccaggttagtctcaaactcctggccttgaaagatcctcccgccttggcctcccaaagtgctgggattacaggtgtgggccactgttccaggccacttgatccaaaaccaccgtaatgaccaatgtttgacccctagatgccaagatattcatcagcaagatctttaaacaatgcctgtagaatagaaaactcttcataaagatgcttatttaacctctccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcgtaagtccctcttatatatttctctctgagaaaatggatttgtcaacctctttctttggcttc

SEQ ID NO: 1868 - DNA, 700 bp, Homo sapiens
tcttggcaagaaagtctgaagacgggaccagctgcacatgttttaccctaagagcttgctatataaaggatactttctggaaggctggttggtgtgaggattcagtcttgcagccactcgagacatcacttctgttcgtaagtccctcttatatatttctctctgagaaaatggatttgtcaacctctttctttggcttctcagctctctcggcctttgggtttgcatagtcctgctatccatggaacaatggctcacaagggccaacacagccttgtctccctcacatctctctgacgacctcatctactacttccagccacctcacttatactacttcagtcactgcttgcctagggccttaggatttcctgtgccctctgcctggaatgtaatccccccagatacctgcacagatgatatcttaccacctcagttctctgcccaaatgttaccttatctgtgaggcctttccagattccatatatgaagagaatcccttatgctctactgtaatgccttctttatttccttgatagcactgcttatagcctgtagttattttacatgttcgttcaaaatgttttcctagggtgcaacacaatgcctggcatacagaaggttcttaataggtatttttgttttttgagacagagtcttgctctgtcacccacgctggagtgcagtggcgtgatcttgg

SEQ ID NO: 1869 - DNA, 700 bp, Homo sapiens
  misc_feature (1)...(700): n = A,T,C or G
ttatgctctactgtaatgccttctttatttccttgatagcactgcttatagcctgtagttattttacatgttcgttcaaaatgttttcctagggtgcaacacaatgcctggcatacagaaggttcttaataggtatttttgttttttgagacagagtcttgctctgtcacccacgctggagtgcagtggcgtgatcttggctcactgcaacctccacgtcctgggttcaagcaagtctcctgcctcagcctcctgagcagctgggactacaggtgattgccaccacacncgggataatttttgtatttttagcagagacggggttttgccatgttggccagactggtcttgaactcctggcctcaagtgatcccccccaccttggcctcccaaagtgctgggattacaggcgtgagccactgtgcatgaccttttaataaatatttagttgactgagtgagttgaggttgaggatgcaggagggagcaggtgccctccaggacagcagtccccaaccttttcggcaccagggactggttttgtgaaagacaacttttccatggatggagggcagggatggtttcaggatgattcaaacacattacacttattgtgcactttattcctattattattacattgtaatatataatgaaataattacatgactcaccataatgtatggtgaaggaagccctga

SEQ ID NO: 1870 - DNA, 700 bp, Homo sapiens
gacagcagtccccaaccttttcggcaccagggactggttttgtgaaagacaacttttccatggatggagggcagggatggtttcaggatgattcaaacacattacacttattgtgcactttattcctattattattacattgtaatatataatgaaataattacatgactcaccataatgtatggtgaaggaagccctgagcttgttttcctgcaactagatggtcccatctgggggtgatgggagacagtgacagatcatcagacgttagattctcataaggaatgtacagcctagatcccttgcttgcacagctcacaatagggttcatactcctggaatcctagaatcctagaatccctactcctagaatcctagaattagagaatctaatgccactgttgatctgacaggagatggagctcaggtggtaatgcaagcaatagtgagcggctgtaaatacagatgaagcttcactcgcttgcaagccactcacctcctgctgtgcaacccaatttctagcaggccatggtctatggcctggggattgaagacccctgctccaagacttacctcccactgagaactcaggcaggatgcttggaggtgaggtgaaaggtagtgggaggaagggaagcccagtgtatgtgtgagtgggtgtgtgtgcttgtgtgcctgagtgagggtgggtgcttctcca

SEQ ID NO: 1871 - DNA, 700 bp, Homo sapiens
tgctgtgcaacccaatttctagcaggccatggtctatggcctggggattgaagacccctgctccaagacttacctcccactgagaactcaggcaggatgcttggaggtgaggtgaaaggtagtgggaggaagggaagcccagtgtatgtgtgagtgggtgtgtgtgcttgtgtgcctgagtgagggtgggtgcttctccaggacccctgtacctcccagttcctggcctgggtggaggctgggcaggacagaggtaaatctgagccagggtctgaccaaggagataacaggttgtgccagaggcaccaggcaaaactggaagggatgggatggagggcatgtggatggaaactattaactctccctggggatgggagggccgaggctttgctctaggggagggggcagtagagttgggccttgaagagtgagtaggagtttgctgagccatgacaaaagaagaaaggcattttgagcttcagaggtctgagggctatgaaaaggtggactagctcagaggatgctggactggactgtctgctgtagcagaggaggtgagacaaagtagtcagcagcccgaggtcagagaggctttaaatgctagtgggaggaccagggactccatcctgagggccccgaggtcagagaggctttaaaacgctaggcagaggaccaggaactccatcctgagggccctgag

SEQ ID NO: 1872 - DNA, 700 bp, Homo sapiens
aaggtggactagctcagaggatgctggactggactgtctgctgtagcagaggaggtgagacaaagtagtcagcagcccgaggtcagagaggctttaaatgctagtgggaggaccagggactccatcctgagggccccgaggtcagagaggctttaaaacgctaggcagaggaccaggaactccatcctgagggccctgaggtcagggagactttaaatgttaggaggaggaccagggactccatcctgagggccctggaagagttgaagcaaaggaatgagagattccttcagctgccctgaaatgggtctaaaaatgcttgggaggcaaaatcctagacacagtgctgggtaggatgttatggctggcatgagggtgtagaggatgatatccatgtctttggtctgaaagcccctgaggtaaggaactgggccctggggttcgagggatgtagcaggtttggggacaacagtgaaagttggttctagccaggtaggctggagcctggagcactgtgaattggggatcctggatctggttccccctcctggagagagactctgatgtcccctgtctcagtactgggaccctgggccatacaaaccttgtcctatgaggaccctgtcccaagcttttcatggtcgactacactcagggcccctgggcagacgaggtgggctgggggactgggtagaggctg

SEQ ID NO: 1873 - DNA, 700 bp, Homo sapiens
gagcctggagcactgtgaattggggatcctggatctggttccccctcctggagagagactctgatgtcccctgtctcagtactgggaccctgggccatacaaaccttgtcctatgaggaccctgtcccaagcttttcatggtcgactacactcagggcccctgggcagacgaggtgggctgggggactgggtagaggctgggccttgaagctggggaaaggacaaatcaggctgtcagctctgaatgccactccccttagctgccctccaagccacccccaaccaggatgcccaggcaggggctgctgtagttgctgcaaccctgaaggggtggagctgttgatctcggggtagcctatggtggcagggagcctcttgggtggtagtttctgttgggggaaggggttattgcatgtcatgggattaaggtgagtaccagcagctagtggatctgtggtggccagtgggagagtcgagtttctgcgggtgagtgggagtgagaggtgggggccagggcccatggctcccggtatttttccacccactcctgtgcttaataatgcttccctgctttcctgggtgccagtcatcctctcctctcccacctatgactgggtggggctgggaccaagtcagcggaggcagggtgggcaggcaagggcagactcctccaccaccccaccctatttgggtgtggctg

SEQ ID NO: 1874 - DNA, 700 bp, Homo sapiens
gaggtgggggccagggcccatggctcccggtatttttccacccactcctgtgcttaataatgcttccctgctttcctgggtgccagtcatcctctcctctcccacctatgactgggtggggctgggaccaagtcagcggaggcagggtgggcaggcaagggcagactcctccaccaccccaccctatttgggtgtggctgcagggagcgtgtgtgcgtgcacacctgcgcagcgctacggtggggcgccctcagggcctcaacgcacacagtctgaccccttgggaagcaaaaggagacaagggccagacatgatctggggtcaccagcaggaccaggacgccaccttgcctcactgctctatcagcacctgcccattgccctgaactgtgctccttcagggaagggaggaggcaaaaggagccttaagagggaatctctagcacaaatttaaccatgaacagaagatctatgagaagaaaggaaaataaaaacttaagcgaagacagacacaacatctgaataaatgcacaggaagtgcagatcacagtcctctctggaggaaaagactaatgccagttcttcccaagtgagtccctagattcagggcaacctggtcacagttcagaggtttgcttttccagagcctgaggcatgcagtctcaacttctgacaactggaaatgtagaggaatagctttg

SEQ ID NO: 1875 - DNA, 700 bp, Homo sapiens
gaagacagacacaacatctgaataaatgcacaggaagtgcagatcacagtcctctctggaggaaaagactaatgccagttcttcccaagtgagtccctagattcagggcaacctggtcacagttcagaggtttgcttttccagagcctgaggcatgcagtctcaacttctgacaactggaaatgtagaggaatagctttgacaggtttgtaaatgaccaacaaggaggagagattggctattaaactccaacacagtagtaattatacattaacagggaaatagatcagatgaccagaatccagtaacaaagattcgtacaaaattaggaaaagttcctaccaatcattaagaagaagttaaataagccttggaaaaaaatcatgaagggtttggggtaacttacacaagaactgctcttttgagagtgaggaccactctgttcccttagtgctaggcacccagcaaacacaccataaatgctcaaaaactgaatgttcatcactggtaatcagagaaatgcaaattaaaacaaacgcatatgacattttacttaacagactggcaaaaatgaaaaaagaaacataatatcctgagctggcaggagcacaaggaaatgggtactgtctcgtgctgatgatgaatgtgaattgataacagtttttttgtgatttgcgatagcacaaaattgaaaacagcac

SEQ ID NO: 1876 - DNA, 700 bp, Homo sapiens
tcactggtaatcagagaaatgcaaattaaaacaaacgcatatgacattttacttaacagactggcaaaaatgaaaaaagaaacataatatcctgagctggcaggagcacaaggaaatgggtactgtctcgtgctgatgatgaatgtgaattgataacagtttttttgtgatttgcgatagcacaaaattgaaaacagcacaaatgtacgttactctgggctcgctaaataggcactaaataaaacgagtcagtttcttctcccgagcaagtaaactagagggtagatccacgcgacccggagtctaggacacatcctcgggagtgaacagccacaattcacagacgatgtgtgcagccggggcatgaaaggcccaaggcaaacccaccacgaggtaaacgccgggactctgaggagaggggtggaagccgggacttcgaggaggggtggaattgacttagagacaggagggagcctcttggagggcaaagctgccctgggcaagtgttcttttctttctaaaccttccttctggtctctgtctggaaatttaagcgcgccccctggtgggggagagaggaaggggaagaaaagggggtctcggaggagaataaagtgctcgtgggtggaagaaacctggaacagaaaatgccagaaaaacctggaacagaagtgcagacggcccgcggcggccccggtga

SEQ ID NO: 1877 - DNA, 700 bp, Homo sapiens
caagtgttcttttctttctaaaccttccttctggtctctgtctggaaatttaagcgcgccccctggtgggggagagaggaaggggaagaaaagggggtctcggaggagaataaagtgctcgtgggtggaagaaacctggaacagaaaatgccagaaaaacctggaacagaagtgcagacggcccgcggcggccccggtgatctccacactcaatcaccctctccaggggagcgatcgctcctgaggctgccagcaccccaccaccacccccaacccgctagtgccgatgacggccacagaggcctttctcgcccccagctcacctttgcacacacagttcccccgtgcagagtttgtgcctccctcatctcttagttctcagctaacactttccctgaccccacccaggtcatacctcctgtcgtcgcgccgcacgcagcatcccagacctcaccttcgtattactagagctggcccgttgtgattcaggtctgccttccacccaggctgtggcccccttcagggcagcatggtacccgtcctgctcactactgcacccagagcctaggacatgcctggcacctaagcagatactactgtactcgggagccatgcatggcctgcgcaggagggtggcaggccaggtgacaggttcaaggtggagcagaggagctttattagagggacagggtgaaacata

SEQ ID NO: 1878 - DNA, 700 bp, Homo sapiens
acccaggctgtggcccccttcagggcagcatggtacccgtcctgctcactactgcacccagagcctaggacatgcctggcacctaagcagatactactgtactcgggagccatgcatggcctgcgcaggagggtggcaggccaggtgacaggttcaaggtggagcagaggagctttattagagggacagggtgaaacatatttacaccggccgagcagggaccttaagaagcaggggtgggagcagggtcccagctcagacgagttccaccttggcattggggtacaccgccaccacgtcgtagccctcgggcggcttcacgcgcgccttggcgtggctctcacagtagagccgctcgtccagaaagaagtaaccacgctgcttgaggttcaggccgcagtcactgcacatgaagcactcgggatggtagagcttgtcccgtgccttgacgatggtgcccctgatggggggaacgagacaggacagcgtcgagtgactgatgggttcacgactgcgcccgcatccagggccctggaaggctagggtccgggaggggcagcgggggcggttactcacacgatgccgtggccgcagcgcgtgcactcgggcagcccctgcaggccgctcagcggagcgcccagcttgctggccgtgggcttgaggttccgggggccgccaggcccaggccaatcccctgaaa

SEQ ID NO: 1879 - DNA, 700 bp, Homo sapiens
tgggttcacgactgcgcccgcatccagggccctggaaggctagggtccgggaggggcagcgggggcggttactcacacgatgccgtggccgcagcgcgtgcactcgggcagcccctgcaggccgctcagcggagcgcccagcttgctggccgtgggcttgaggttccgggggccgccaggcccaggccaatcccctgaaacccggagcgtaggtggcatgaacggggtgaggaggtcagaactccatttctgcggggtgtttggttgggcgccagacgggccatcggcacccgagactggggaacgggtttggcgggcgtggggtgaggggcagcgacagggggtggagagggaatcaggaagccagggcgtagcaaggtcgtagcaagggcgtgggaccgggccgcagagaccgaagagggcaggtgactgcgaggcgggacgtggggtcgctagggggcaacctgggcactgcagggagtgggaaggcagatggggacaggtggcaggcgtcttaccgccctcgccggcctctagcatgccctgcaagtagcggaaggagcctgactgcttgggctccgcggccacgggctcggccggctcccgcagcatcctgtacacctcggagcccaggtcgattctgcagtcccggctccgcgggaggcctctggctgggtcagcgctgggagggagaaagaaa

SEQ ID NO: 1880 - DNA, 700 bp, Homo sapiens
aggtggcaggcgtcttaccgccctcgccggcctctagcatgccctgcaagtagcggaaggagcctgactgcttgggctccgcggccacgggctcggccggctcccgcagcatcctgtacacctcggagcccaggtcgattctgcagtcccggctccgcgggaggcctctggctgggtcagcgctgggagggagaaagaaatagaggaggaagggatgcagttccagccttcaccctgtggacttggggtctggtaaggcttatgagtcagaatgcaaccagctaagacccaaggatcaagtgtcaggggtcagagtgggactgggtgagatttgagggatcaagggttaagatgggttctgggcatggcaccgaaggcatctctgtgctacctggggggtggagacacatgcagggtgctcatctgggctggcagggtggcctcgctgctgccattgtgagggactggaaagcgagggggttgtccatatggagatcccaggcttggtctgccatcttctggcccagtcccggtgcctgagggccgcctgctggttgttgggctgccgtcctattagagagaggcctaaggcactgggagaccctctggcctccagccattccttgttcaccccacccccaccctgctgtgctgtgccaggtggtggatgtcagttggcttcctctgcttcggcatctct

SEQ ID NO: 1881 - DNA, 700 bp, Homo sapiens
ggcttggtctgccatcttctggcccagtcccggtgcctgagggccgcctgctggttgttgggctgccgtcctattagagagaggcctaaggcactgggagaccctctggcctccagccattccttgttcaccccacccccaccctgctgtgctgtgccaggtggtggatgtcagttggcttcctctgcttcggcatctctggcctgtggtgctcagccagggaagggatttctggggaagggctgggcctggggactggttatgcccctgcagaaatgagaaacgtccttggaaagtcagacacaaaaacctgggcagctgagactcagcctgggcttgtgagccctgcagtggttctgcccaccaccactcaggaagggacagtactggggcaggcctatcccaagaagcctaaggtctgtgtggctacagcagagtatgtggcctcctggcagaggtggccctggtgccaagccttctcaccttcctgaactgtggtgggtactgggtaggcccatggctgggaactcaaaaaacgtaactcctgtcctacagtcagaaagggtccttgactgtcatgtgtccaaggccctttgggcaggctgaagctcaagagtgccattgtgaggtcagccccttctgggcctacacctgtcccccatttcctgctttccaggccacaatgagtagccttctgcag

SEQ ID NO: 1882 - DNA, 700 bp, Homo sapiens
ggtactgggtaggcccatggctgggaactcaaaaaacgtaactcctgtcctacagtcagaaagggtccttgactgtcatgtgtccaaggccctttgggcaggctgaagctcaagagtgccattgtgaggtcagccccttctgggcctacacctgtcccccatttcctgctttccaggccacaatgagtagccttctgcaggcacagcagatgaggggcagagaccaggctagggctcaaggctctctgccccactaccccacagccagcctggtgcccatggctgaaacattttgggtgggagtgtcctgaacctgccccctcagccatgaggagagggcagtatctctgtgtgtgtgggtctgagtggggactggggatctttgtccctgcagagtccagagctgtgcagttcccagcttgcaagtgcacacaagcaccccacagcaatgtaaacaggggcatgcacactctcacaattatgctttaaagacacacacacacacataaggacaacacatatgcacctaccaatctccctacatacaactaactacatgcgcatggttacagagacttggagccagcactggtcaccctgggaatggccatagtggcctccatagctgagactgggctagtagccagagcagcctgattttaggatgatgtctgaggccaggccatggggtaggtcttag

SEQ ID NO: 1883 - DNA, 700 bp, Homo sapiens
cacacataaggacaacacatatgcacctaccaatctccctacatacaactaactacatgcgcatggttacagagacttggagccagcactggtcaccctgggaatggccatagtggcctccatagctgagactgggctagtagccagagcagcctgattttaggatgatgtctgaggccaggccatggggtaggtcttagcctcagcctgggagtgacgtgtaaacctcctctgctctacagtgtggtcagagagcccagtgtggacaggaaaggatgcctatcgtagtgggaagaaccctggtttggacttaggaagctctgaggcatagttgagcctgtggggttctgccctgagtaccccctgctttttgtagggtgggaacctggggaacaggcagaccagcagttgggtgggcccccctccatttcccccaccccaacagacaaacaggagggtcttgctgcccaggtggcccccatcaatgcagcagcaacaggaaaacccctatccacatcaggcccaacaaaagcccctgagaaacgtgagcgctctcacacgtgtgtctgtcgggcaggcatgcaggcagggctgacctctaatggggaccagatgggctgtggccagtgggggtggggctcagcctccgggcagaggctttggtgggagggaggagttggagggactgggactgggagga

SEQ ID NO: 1884 - DNA, 700 bp, Homo sapiens
aaaacccctatccacatcaggcccaacaaaagcccctgagaaacgtgagcgctctcacacgtgtgtctgtcgggcaggcatgcaggcagggctgacctctaatggggaccagatgggctgtggccagtgggggtggggctcagcctccgggcagaggctttggtgggagggaggagttggagggactgggactgggaggaaggaggccctcactcacccctacccagcagggtgcaggggtccactgcagggccatcagagccactgcccctcccacggtcacccatgcagctgcctctctaggcctgaactctgtggctaggacacacatggctacctcagttttagtttgagtcccagggttatcccctaactgggcaagtctcttcacctctctgaacctgtttctttatctatgagctggggaatgtgatgctttccacatcaggttccttgtggagatgaagtaagacaattgcatagtgcctggcataaagcacatacttgttggatgaatggctgtcaggggaattcctgggcccccagtcctgtattttccccctctgtgggtggtacacctcgtaccatatgctcctctgctctgagaaccagcctgctgcccacttggttgttgaagcctcagtggatttttcagcaggatgggggtaactacctgctttgggacactcaacttggatgg

SEQ ID NO: 1885 - DNA, 700 bp, Homo sapiens
atacttgttggatgaatggctgtcaggggaattcctgggcccccagtcctgtattttccccctctgtgggtggtacacctcgtaccatatgctcctctgctctgagaaccagcctgctgcccacttggttgttgaagcctcagtggatttttcagcaggatgggggtaactacctgctttgggacactcaacttggatggaggcaggcgctgagtccagatgagcaggtgccatctcctagaggctcagttctagctctctgctggtctggggaggacaggctgagtgtgcaaggactgcctgctccacctgacttgcttctccccatcacctggttctgagcataattgccactccttccagaaaaccctactaacccagaaggatagtaataagttactatccttcctccaccctgggctaggccaagtgcctcctgtgttcccacaagaggcctgagagaaggaggttctcctatcgccccacagggaaggtgggcctgaagttccagctggccctgtcccatcccactcggggatgtgtgccagggcaccttgtgctggtcctagggccaactgtggtttcctcctcctcgatggctccagctagctccaccccctccccaacacccccactcaggcagagggtgggagcagcatggggacaatgggccctgtgtctgtgttagcaaggactcagc

SEQ ID NO: 1886 - DNA, 700 bp, Homo sapiens
tgaagttccagctggccctgtcccatcccactcggggatgtgtgccagggcaccttgtgctggtcctagggccaactgtggtttcctcctcctcgatggctccagctagctccaccccctccccaacacccccactcaggcagagggtgggagcagcatggggacaatgggccctgtgtctgtgttagcaaggactcagccctgcaggggtggggtgggggtgtttttgtcaccacccatggagcccatgaccttttaagtacaaaagtggggcagcagctgaggggctgccctggtgcttgtggaaactccctccttctccagtctgagccactggcagcctggtcttcaagggagtcaatgagaacaagtgtgggggcagggggagctgctctacagtcgccagcctcccaggcccaccggccctgagcctctcctggaagactgaaccccctccccaccacgtcatcctggcactgctacctctgagggaggctgggcctcatgcatgagcttgaggcccacaccctgctgctcccctctgcctggcctgtggcaaacctggctcatttgtctatggcaacatgtacccctacccctaaggtctggggtccatggggccatcagagcaagtttctgagacacagatgtggccatgaatccctgtaagaacagctgaggtccaggatagagaagccca

SEQ ID NO: 1887 - DNA, 700 bp, Homo sapiens
cctcatgcatgagcttgaggcccacaccctgctgctcccctctgcctggcctgtggcaaacctggctcatttgtctatggcaacatgtacccctacccctaaggtctggggtccatggggccatcagagcaagtttctgagacacagatgtggccatgaatccctgtaagaacagctgaggtccaggatagagaagcccaagagcctttctgtggccctgctccaccacctcatctctcacctctgtcctctcactccttccatcttgtcctcccttcccctggacctttcttttctctgaacttgtggtgcaagacctcacctctgggccacacttcctctccctatacccctttgcctgccttaccattcctagcccttcaggtcttggcttcaataccccttcctccaggaagcactccttgactccttgtctgagtcatgtgactactctgggctcctttggcccctggcttcccctagcccagaacttctaagtgcctttcccctgccagaatgggcactgcctggaaggtggtaagcatctggctccagggatgccagccaggcagggtagggaatagagcaagatgggattggggtagatagtgagggagaagctggggcacatccttccctctggttcagtgaagcctctccctgccttggccccttttctttcatgttgagagggtggaca

SEQ ID NO: 1888 - DNA, 700 bp, Homo sapiens
cctttcccctgccagaatgggcactgcctggaaggtggtaagcatctggctccagggatgccagccaggcagggtagggaatagagcaagatgggattggggtagatagtgagggagaagctggggcacatccttccctctggttcagtgaagcctctccctgccttggccccttttctttcatgttgagagggtggacaaaggcaggcccaggaggcaatggtcccacatgctgggtcccatggttctggctccatcacagaccatcccagtctccttgcccaaactctgtggcccagagatggctctggatacctcagtcatccccacttggctactccttatgccatggcaaaacaaggccctagaatagcctgaccccctcactcttcttgaggacaggaccagagatatgacttctatcacacacagaaaggtgactgggcagacaggcctgcagcctaagttctgctagaagcaccacaggatggccaggagagaacttcaggcttggatagggcactcagaggagtgtcccatagcctgaggtcactccacagcctgagactgccaccaatctcccccgctgcaagcacagtgacttctttctggtctggcatcactgagcaccagagtgaactccagctggctgtgtgatagccgcaaaccaaggcctagcccagatcctggacatcatagg

SEQ ID NO: 1889 - DNA, 700 bp, Homo sapiens
aacttcaggcttggatagggcactcagaggagtgtcccatagcctgaggtcactccacagcctgagactgccaccaatctcccccgctgcaagcacagtgacttctttctggtctggcatcactgagcaccagagtgaactccagctggctgtgtgatagccgcaaaccaaggcctagcccagatcctggacatcataggcaccttggtccagaatccaggattgcccggagtagagacagagcccacaccaggtgctcatcatctgaggaacatgggatggggtatggatgtggtccagagaaaacttctgcttcagtctctgtcttgggtatctgagagccccagtgaggacattcagtgcaggtgaacctgcatgctggcccctctgccctgggctcactctgagccaggccaggccaggcagtgtctgtacatacctggatctcaggatcgatgtggatcctgtgtgcctgagccttgctgtcatcaggggcactgggccagctcctaccctcaggcctgtggcagaaattgtgatggtcagatatgtctcctaccacgcccaccatgcctgggagccaggatcaagaggggctgggctctgggctgtgccctgcaggtagaagaacaccactccagtgctttcccctgtaccacaatggtgactgttgtggcaatgagccacaactctagctgcc

SEQ ID NO: 1890 - DNA, 700 bp, Homo sapiens
ggccagctcctaccctcaggcctgtggcagaaattgtgatggtcagatatgtctcctaccacgcccaccatgcctgggagccaggatcaagaggggctgggctctgggctgtgccctgcaggtagaagaacaccactccagtgctttcccctgtaccacaatggtgactgttgtggcaatgagccacaactctagctgccatcctcctggggtagggctatatgcttctgtccccatcggctgcccaatccctctctagtctggttcctggagaggctgcaggagaagccctgtgtcttccctaatcttccaccctcttcgtggcctacagaagctcagctcaaagaggcccagcttatagcactgcaagccaggcctcacacattgaccagctagaagcctatccacgcatcctctgggcatctacagcctctggtggggtgtggggtcaggcgtccgtcggctctggggtaggtggaatggaggctctgaggggtgtgtctttcctcctgctgctgctgccggcagagtcatcactgagtctgcccagcccagatgggaaacaggccattaggaaattcctgcttcgccatagaaaccaaaagccaaacaccactcaggagggagaaaaacatcataaacctgccataagcagggcaggcaggccgagaggctacgtgcctaaggcccagccctgtca

SEQ ID NO: 1891 - DNA, 700 bp, Homo sapiens
tctttcctcctgctgctgctgccggcagagtcatcactgagtctgcccagcccagatgggaaacaggccattaggaaattcctgcttcgccatagaaaccaaaagccaaacaccactcaggagggagaaaaacatcataaacctgccataagcagggcaggcaggccgagaggctacgtgcctaaggcccagccctgtcactcagtagccctgtgagaaggcaggccaggaaggggcatggaccctggactggcaggtgggtatgaggtgaggctggttagaccaaaggggaataatgccctccaactcaccccacgaagcctcctgaggcttctcaaggtctcattactgacctagcagcttgcccctgcctcttctgcccccttcagttgagggttttaataatctatctatgcctatggtccatactcactctgcacttcctcgcctctgcccattccttagtcccttggaggctacctctctactccaggcctttggtattagagctctgctgccccagggcaacaccagccccatagtccctgtctctagccccctcaaccaggctcccaagtgggtaccctaactcacagctctaactgtggcctctatctactcagaactcctctgggataaagctgggacatcttgtgtggctatttggccttcaacttccctgaagttctgcccagaagag

SEQ ID NO: 1892 - DNA, 700 bp, Homo sapiens
gtattagagctctgctgccccagggcaacaccagccccatagtccctgtctctagccccctcaaccaggctcccaagtgggtaccctaactcacagctctaactgtggcctctatctactcagaactcctctgggataaagctgggacatcttgtgtggctatttggccttcaacttccctgaagttctgcccagaagagcagtacaagcctgacgtctaaggtcgaagggcacaaagtacccagagccattaatgtggcccaatgcatcagatcagaatgaagggcttaatcatgtgtcaacccccatcccaggctgggctctttaaacaaaatgacaggcaaagggtaggctgtgcaaaggtaccttgggccacatgtgatggacaacagggactctatcagtggcctcagtgttggagttgatgtcagaaaggtcctggacctatagaacatgcccaggaagtgtgattttgcttggattgttggatgcctggctttgggctcaaagcaaaagaagcccagtggggaagctgggcctttgatacacttttcattctgtgggggagttggtggggggattagagctctctgtacacaagagggcagatagggaagctggtctggggtagaaccctgggagtgagagcacagggtagctcactccagccagctcaacaggctgatttactgcagagccc

SEQ ID NO: 1893 - DNA, 700 bp, Homo sapiens
gggctcaaagcaaaagaagcccagtggggaagctgggcctttgatacacttttcattctgtgggggagttggtggggggattagagctctctgtacacaagagggcagatagggaagctggtctggggtagaaccctgggagtgagagcacagggtagctcactccagccagctcaacaggctgatttactgcagagcccttgctgtgtgggtgtgtgtggtgggggcggggaggagtgtcgttgggggccaggcataggtcctggcatagcaggcaagatagggagcagagtcagaaagcttgcaggtgggcaagtgtccaggagaagaaatgttggctcagaaagtcaaggtggccctcatgtcttgatcccccagagtctgcatgtgtgagggctggagatgggggctgcagggcaggactcaggttttcactctgactgagcaggcctggtacatcatcactcaatgtccagagcgcaagatggtccatatttttggttgaggaagttatgggctcaagagattaaatcactttctggagcacagcatagttatctctccctctctctcttttatgggtaaaattatgagcataattctcaacccagctctgtaatagtagagaatgtgctctcatctgctccatggccagtgacattttggggctgaaatgctcagagtggaacaggtcagtgga

SEQ ID NO: 1894 - DNA, 700 bp, Homo sapiens
gttgaggaagttatgggctcaagagattaaatcactttctggagcacagcatagttatctctccctctctctcttttatgggtaaaattatgagcataattctcaacccagctctgtaatagtagagaatgtgctctcatctgctccatggccagtgacattttggggctgaaatgctcagagtggaacaggtcagtggacctctggctccatccatgcctggtttggaacaaaggactggggaaggaaggaaggaaggaaggaaagaaggagggggacctccaccccaccaccctccgctgacatcatacactctgagaagctcctgactcaggccccctctgaggcactcctccccactactccactaccactagggctgcccttgttcagccacacagagtcaaggctggaggtgagtcaggggccaggatcccagccaagtggggaagcttcagaggtcactcatgggcagagcaatgctgacatttcccccatccagcctgtatctcagtctggaggagggtgatgaatgtgatccgttaatgggaaaggaaaccccgggctcatagaggtcatctgggcacctaaggctccagaggctggatgaggaccagctttgctgaactccaaagatggagcatcctcaccgtgtgccagggccaagcacaaacagggctgacctcacaggcctctccac

SEQ ID NO: 1895 - DNA, 700 bp, Homo sapiens
agcctgtatctcagtctggaggagggtgatgaatgtgatccgttaatgggaaaggaaaccccgggctcatagaggtcatctgggcacctaaggctccagaggctggatgaggaccagctttgctgaactccaaagatggagcatcctcaccgtgtgccagggccaagcacaaacagggctgacctcacaggcctctccaccatgtttaaaggctccaagccagtggcttacctcccaccctgccagctcagaggcatggttagctgtgttgtggtttggggaggctttgcccacgtacttccacagggggtcatggaaatcccctcagcagtgaacacggcagagctgataagttatgcccgacttctgtggatcaaggtgggcaggggagtggggagatcccactcagccaggcttaggccaactgcttctcagagctgagtaaagacccaggacctgagcaaggctgggtccccccacccccacccccagtggaccttctatcccaggatcatttatggagcacagatgggcttggtaaccccctgtcctccccttcttgattggctgcaaagcattacacagtccttagtgggaacttttcccaaatccagatttaaccagggcagaggtgtgggccacggtggcgacagctgtggcagggcagctgaggggctggtaggagtagtcagcagccaag

SEQ ID NO: 1896 - DNA, 700 bp, Homo sapiens
ctatcccaggatcatttatggagcacagatgggcttggtaaccccctgtcctccccttcttgattggctgcaaagcattacacagtccttagtgggaacttttcccaaatccagatttaaccagggcagaggtgtgggccacggtggcgacagctgtggcagggcagctgaggggctggtaggagtagtcagcagccaagttaagggtctgtagtcttaggagagagccccaaaatcaaattttgctaccccactccctctctgtgtgactttaagcaccatctaacctttctgagcctcacttgtctcatctgtgaagtggggactatagtagcccttttttaagttggtaaatgagggttaaatgaggtgttgcacaagaaactactttgaaatggtcatcaagctggtcactcaggggaggggaaaggaatgaaacaaatgccccagaggctattcaaggtcttatttcagttgcctgcaacacttgccataagtgccccaacacacttctagtctaagttaaaaggggatttcttcccttcttaagctataactctaaacagtatctgccaggcccccatgaaagtgctactccttgggactgttcctggatggggcacccaggagctgaggcagagaggctgtgtgaagctgggctcacccaaaatgccagctgcccataactgcccacctcgtc

SEQ ID NO: 1897 - DNA, 700 bp, Homo sapiens
cccaacacacttctagtctaagttaaaaggggatttcttcccttcttaagctataactctaaacagtatctgccaggcccccatgaaagtgctactccttgggactgttcctggatggggcacccaggagctgaggcagagaggctgtgtgaagctgggctcacccaaaatgccagctgcccataactgcccacctcgtccttccatcctcccagcccagcccacctgtgcatacctgctcacagacagtgtgaggtgatcgtggcagcccttgatgcggttctgtgcctccaggtgtgtcatgagctctgtgctctcaccattgatggcctggatcaggtctcctgggcacagggcagccaatgcagccttgctgccagcatggacctgcgagcagacaagccagatggctgggcacagtcatgatatggtcttgctgcaagctgtgccctaggcctcctccaacctcagaacctagccagtgtggcctgctaccagcatggcctgtggatgggcaagccgagtggctggttgaggtccccatgtagcctggctgcagccttgctggaaacacctccaactccagcacctggaggcctggcagggcatgaggatatacaagaagggcttcctcagggctgggacaaatggatgttgttcttgcagcctgcgtatgtgcccaaggacatgcaggggacac

SEQ ID NO: 1898 - DNA, 700 bp, Homo sapiens
tggcctgtggatgggcaagccgagtggctggttgaggtccccatgtagcctggctgcagccttgctggaaacacctccaactccagcacctggaggcctggcagggcatgaggatatacaagaagggcttcctcagggctgggacaaatggatgttgttcttgcagcctgcgtatgtgcccaaggacatgcaggggacacagagacacatggagacataggtgctcacagatacatacacagcatggacatatcacagataccctacacagacaaggccccaaccagacagactacacaccttgacctaatattcaaacccttagtgaccttgccttcctacttgcttgatttcaactctcatccccacctccacacccacactctgtccagaccatgtgaatgtctatggggtgctcacaggcaccatatatcactcacctctacacttctgcaaaagctgctccctccacctggaacattcctttgactcccacatcctcatccttcagatctcagcatagaggccacttcctctgggagcctctctgggatctcactacccagtgtgctcccatgaccaccttttccccctacactgttcatgttaatacttcattataattaaaatgggaaggtctgaacatcacctccctgagcaagtccagggccatccagttccagctgacagcctgcgtttg

SEQ ID NO: 1899 - DNA, 700 bp, Homo sapiens
tcatccttcagatctcagcatagaggccacttcctctgggagcctctctgggatctcactacccagtgtgctcccatgaccaccttttccccctacactgttcatgttaatacttcattataattaaaatgggaaggtctgaacatcacctccctgagcaagtccagggccatccagttccagctgacagcctgcgtttgggggtcagaattctacctctacttcccctgcaggacaggaactcaggctacctcagtgccactattgacccctcggggtcaagcagtgttcacacctggaagctcttacaatgctggtcaactgaagaaggctagaatggggggtggagttagactcacagagatatctaagtaagcaactcaggggaatccaggccatggagcacccctcaccctgccttgaccccaacatagcctttagaaatatatttcttacccagcctctccagccagtgcccagctggttcaaaagctgccagtgaccccattcttttgggtgggagctcctactggtgggaactcctggaagcccagctaggctcagttcagccaggtctcagtagtgagtggacaaagctgaggtgctggcagctccttggctggaggcctggtgttggcactgcccaagctgacctgccctgaagtaggctgcctcaaggaaacgttcttctgaagcatga

SEQ ID NO: 1900 - DNA, 700 bp, Homo sapiens
  misc_feature (1)...(700): n = A,T,C or G
gaccccattcttttgggtgggagctcctactggtgggaactcctggaagcccagctaggctcagttcagccaggtctcagtagtgagtggacaaagctgaggtgctggcagctccttggctggaggcctggtgttggcactgcccaagctgacctgccctgaagtaggctgcctcaaggaaacgttcttctgaagcatgacaccctcanccaactagcccatcattaatgttcacttgtagggcctgggcacctgtgcaagcctgtcatcctgggggagacacccacttggcaccatcccaccctcccctcaaggccatcctctgcctcctccccttcatggatacctgccctgtgccagggcctgggctctatgctttacccataactagctcacagcaacccctcaaccacctggtgaggcagaggctgttctcatccctattttacagatgaagagaaagaagcttgggggagggatgccatgccccagtccccacactggagaggagtctttcttcagggggcggctaactgcggcaggatgactcagccagcacaaggggtacattcaggcttctgtgggcggaggaagtttcttgaaagcagtggtggctgggatgctgccagctctattgagctaggggagttctggtcagagagggcgtgaggccaagaaattgtgactctcccagtcacct

SEQ ID NO: 1901 - DNA, 700 bp, Homo sapiens
ctggagaggagtctttcttcagggggcggctaactgcggcaggatgactcagccagcacaaggggtacattcaggcttctgtgggcggaggaagtttcttgaaagcagtggtggctgggatgctgccagctctattgagctaggggagttctggtcagagagggcgtgaggccaagaaattgtgactctcccagtcacctttacatgcattatctcattaatcctgaaggcaagcccatttcctagatcaggaaacggaggtccagagaagtacagaaggatagttaattgataaaagactgaatcaagatttcaatccaggccacctgattccaaatttaaaactatgctcttaacacctgcatttttcttccaaagggggtaagggaaaagagagtatctgagggagagatagtgttccaggcagaaggaccagcatgtataatggcatatctggagagaaagaagaaggaaggttgtatggccggagcatcatgagtgaggggagagtgggagagatgaagtcagagaagaggcagggatcagatattgcagagtcttgtacacccgggtgggaagctggcatttctcctgggtggctgggaaccatggagggctctaagcgggaagtcacaggacagagtggaattcaggccgatccgtctagctcctaagcacaggataaacagaaagaaggaac

SEQ ID NO: 1902 - DNA, 700 bp, Homo sapiens
  misc_feature (1)...(700): n = A,T,C or G
gaggggagagtgggagagatgaagtcagagaagaggcagggatcagatattgcagagtcttgtacacccgggtgggaagctggcatttctcctgggtggctgggaaccatggagggctctaagcgggaagtcacaggacagagtggaattcaggccgatccgtctagctcctaagcacaggataaacagaaagaaggaacagagacaggaacagtgaagtcaggtgggcggtgagggcatgaatcagccccttaccggtagtggctgcattcccagcccctgctccacccagcctagatgtggtgggctgggagtccaagtcagaaccaggtgccacattgtcctacacagtcacagcaaactgcagactgcctggattcctcctgtctccactctgcttctctgggttgattacattagcctctctgtgcctgggtctccatctatgtaaggccagagggagtccttacttntaaaggctgttgtaaggactatttgagaaaaacagggcatgtaaagcccccacaggaggctgggcataaggtggtgctcactacagggactggagggagctgttaccaacacccattagggtagggcctggcacaccctggatgcttggccaaggccagccatcattatagcttgtggggaaggagccccggatgatgttcttgggactcctggaggcttcatgggc

SEQ ID NO: 1903 - DNA, 700 bp, Homo sapiens
aaaaacagggcatgtaaagcccccacaggaggctgggcataaggtggtgctcactacagggactggagggagctgttaccaacacccattagggtagggcctggcacaccctggatgcttggccaaggccagccatcattatagcttgtggggaaggagccccggatgatgttcttgggactcctggaggcttcatgggctgagattgcaagcccccagccctgccgggccgatagcctcctccctgtctgtgtgaggctgtccctccctaccaggtcccgcgtaggggaggtcctggaagcaagggaggggctggatcttgagccccactggtgaagacactcccacatatcttcagtccctgtagacctgccccagaggtacctgctaggcaagctgtggcctgtgcctccccagcgctgtaaatctccccagatcccacccaaacccaacctcagccatcctggctccttgggcctgagctgctgccgcgtgactttgggggacaaaggaggctcttcctggcaaaccttctcccagactgcctgcctggggcctgcatccccagtcagctccaaacaaggctgttgctgctgctgctgccgcagccgcagctgtgacgtgtggaggcctttcctcggagggcaggcagccgcgtgggcaacagatgtctcagctccctgccgcctgcagccgtcag

SEQ ID NO: 1904 - DNA, 700 bp, Homo sapiens
gggggacaaaggaggctcttcctggcaaaccttctcccagactgcctgcctggggcctgcatccccagtcagctccaaacaaggctgttgctgctgctgctgccgcagccgcagctgtgacgtgtggaggcctttcctcggagggcaggcagccgcgtgggcaacagatgtctcagctccctgccgcctgcagccgtcagccgccgccactgagcctgtcagcggcctcacgcccagggtgcctggccagcccgcttagtgtccccaccagccccctcagcggacacacagcatgacacacacaagcagacacaggcttgcgtacacacacacacacacacacacacacagcaggaatcctataggaaagaggagatgaaaggctctgggatgtgttgaaggcccacctcactcggccccagggacctggcagtgagggcagatgtgggaagcctcctaggacagctgggcctgcctgtcaccctggcccccagaaacgggattccatgattccacgctccacctggtgcccaccccctcccaagaactggacagaagtctcttaaagcccagccggcttggcccagcccccatggcaagaggtggcagtagggtgggggaaggtgcttctctgtgcctctgacacaggcccccaaagacaagatcagcctgtgtgggagcaagggatggccgtcagatg

SEQ ID NO: 1905 - DNA, 700 bp, Homo sapiens
gattccatgattccacgctccacctggtgcccaccccctcccaagaactggacagaagtctcttaaagcccagccggcttggcccagcccccatggcaagaggtggcagtagggtgggggaaggtgcttctctgtgcctctgacacaggcccccaaagacaagatcagcctgtgtgggagcaagggatggccgtcagatggtttcaggttatctcctctgctccttccagactgagagccgccaagggcagggcctgggttctctcctcttctgtcccttaggctggggacccccaagggcagggtctgagtcctctcttttggccctccagacacgaggatgtcgaggctgggccaggatcctgtctcccctagacaggcaccccctcgaacagggcctgagtcacctcctccactcctctatcctcagactagccacgctccagggctgtgccggctccttttccttctctgtgggcaaggcagggccctgggaaacttgaggaacgggcctgaggctgtcctggcccccggctttgtgtcatcttgtggggaggggtctcacaacctcacagttaagtctccctttcccctggaagccaaaattcctcctggtcacttccccttagggtgactgaggtcgtgaatgagagactgactcacgcccaaagtgggaagtggatggacctctgtcttctca

SEQ ID NO: 1906 - DNA, 700 bp, Homo sapiens
tgaggaacgggcctgaggctgtcctggcccccggctttgtgtcatcttgtggggaggggtctcacaacctcacagttaagtctccctttcccctggaagccaaaattcctcctggtcacttccccttagggtgactgaggtcgtgaatgagagactgactcacgcccaaagtgggaagtggatggacctctgtcttctcagattcagcgaggaccccagacctccctgggtcaccaagctctgccggcagggacccctgataggggaaggggggctctaaatcattttgccccagatcttcaggcagggggtgagtctgaagagtttctgggcctctgtagagctgtctagacccctggcccatctccgcgggtccttcccgggtccacagtggctcccccagatgaggccagcggggaggcgggtgcgtgaactcttgggagattcttcgcgggatcgggcagacaggcccagcgtgggaggagggcggctggggctgcctgcctctgcctggaagccgcctctacagcatgcggggcgcccaggccaaccctccgccttcaagcctcggatacacaggggatctgggtcccgggcggaccgcgagaacccggtctcagacatgggaccgccctgccgccacgcagccgccagactcacccgtgagatggtgaggggcgcgctgaagtcccggccgccc

SEQ ID NO: 1907 - DNA, 700 bp, Homo sapiens
  misc_feature (1)...(700): n = A,T,C or G
ctgcctctgcctggaagccgcctctacagcatgcggggcgcccaggccaaccctccgccttcaagcctcggatacacaggggatctgggtcccgggcggaccgcgagaacccggtctcagacatgggaccgccctgccgccacgcagccgccagactcacccgtgagatggtgaggggcgcgctgaagtcccggccgcccaccaggcggaagccccagggcgaaggcccgcgcagggtcacggaatggggcatcgcgggctggagccgcagccggagcctgagccggactctgaggagccgccgccgccgccgccgcctggacgccgcgccccgcccccggcccgcccgcccctgtccccactcggcccagcccccgcccccgctccctgtgcgcctggattggccccgcggccagcccgaccctcccacttcggggggctctgaggacccgccctcagccccggctgccggcaacccggcacccccactcagctctcagagatccccgcgttcggacggccccgacggcctggatcctgctcgggccttggatctgcaggccgcggacccaaacccagctgtcgacaccggccctttgaagtcgcttttaggggcggtgctccagccngaggagggatggagggcccacttgggggatggggctgccccagctcagatacctcctcatgggcccgactg

SEQ ID NO: 1908 - DNA, 700 bp, Homo sapiens
  misc_feature (1)...(700): n = A,T,C or G
agatccccgcgttcggacggccccgacggcctggatcctgctcgggccttggatctgcaggccgcggacccaaacccagctgtcgacaccggccctttgaagtcgcttttaggggcggtgctccagccngaggagggatggagggcccacttgggggatggggctgccccagctcagatacctcctcatgggcccgactggcacacctgcggcccatcctgccgtgtgaggagccctctgaaccaagaaccctatgaaccaggggcttgcgcagcactgggccggggacgcagacccaaaacgacagcaggcagcgccgagcgtgggagtggacacagaaaggtcctcagactagtttgtggaggccagtaaggcttcctggaagaggtggtccctgacttgtatctggaagcaaggtgtccctgcttccccagaacattcaggccttctcttgctgcttgcaggctcctcgcaggccacctccctgtctgcacagccccctcccctcgtcctttgccaggagatttgtttccccaggtctcctgagaaagtagcagctggagcggctggggtcgtggctgtgcagtgtaaagggaagaaatatatgcagcgcttcactttgggcccttttctctccaaggtcttctctccattcccaaccattatcctccggggatgtacttgaacagccaatgcagat

SEQ ID NO: 1909 - DNA, 700 bp, Homo sapiens
  misc_feature (1)...(700): n = A,T,C or G
ctcccctcgtcctttgccaggagatttgtttccccaggtctcctgagaaagtagcagctggagcggctggggtcgtggctgtgcagtgtaaagggaagaaatatatgcagcgcttcactttgggcccttttctctccaaggtcttctctccattcccaaccattatcctccggggatgtacttgaacagccaatgcagatgccatggcaccaccaacctccctctggttctctcggcacttctatctggctacatcagggagacaccttttacttttccagactctgtggaggtctctcatttagcccaaatccttaaccttatgtgtccttttagtcaagctgtgataaggaccctgctcttgggctcctcacaggtggtgggatgaaatgtgtccactgggtctctgacaacccgcaaagaggagaactgcttgagaagcacaaacctagggcagtccaaggaagggaggggcccttcanagtagaatgtgggtgcctctgtaggaggcaagatgctgctatctgttcagctgggagagaaacaagtggtgtgtggtagcggtgtttatatgggagtgtatttggggtgtgtgtgtgtgggggggtgcggtgtctgaatccattagagcaccagccattgggctgttctccatcactttgtggtggaggaggtttctgctcagccccttgcagacttg

SEQ ID NO: 1910 - DNA, 700 bp, Homo sapiens
ctgtaggaggcaagatgctgctatctgttcagctgggagagaaacaagtggtgtgtggtagcggtgtttatatgggagtgtatttggggtgtgtgtgtgtgggggggtgcggtgtctgaatccattagagcaccagccattgggctgttctccatcactttgtggtggaggaggtttctgctcagccccttgcagacttggatcccaagtgaagaaaggtggaagggccagcaggagagctggtcactgcattgtctctctgaggtctgtaggccagaagctccccaggacttagaccctactaaatggggtagagagtaaggggcagccatcacttatcactggctgtcctgagggtttggtgtacagcatggcttgtggtcagaggcctgtcagctgggctccaagagtcctagtgaatgtaaacagtgcagaccttttctggggggaagggatcctcaagggtctgtggaagcttccacccaatgtatcccaaagtgaattcctgaaactcctcttcatacattgcttgtttcccccgatttcacatcccaaagactgcctacactccttgcctccatcctgaaattccttcattacccgtttacttctgtccgggggaatgtgaagtggtcctcctgaatatgaccttcctggcccctgagtctctgggcagtgtaatccatctccaaaggcttct

SEQ ID NO: 1911 - DNA, 700 bp, Homo sapiens
aattcctgaaactcctcttcatacattgcttgtttcccccgatttcacatcccaaagactgcctacactccttgcctccatcctgaaattccttcattacccgtttacttctgtccgggggaatgtgaagtggtcctcctgaatatgaccttcctggcccctgagtctctgggcagtgtaatccatctccaaaggcttctatcacaagtttggaggtggaggtggggtggggactctggatgaattttttagaatctggtccataaacttccccatttcattgggcagcatctggacagattggaatgatgcaggatccgggtccaggccagtcattccctcacatgagctcatgttgacatccctgacttaagagaacatcagaggcttacttctgactgtgccttcccacaggggagatgccaggtcaggttctgtacctggagtttgggggtggcccttcttaggggccatgctgtaaacccactcataaggtaccctgagttctaggcagcaggtcagacaagctgcagattctatggcttctccagctctcccgaaagttctttaaggaagccctcagatttccttttcccctgtaatggccttggtccttggagattgctgtattgctgagaccctatcatgctggaataccaagtcataaggcagtcacagggtctggaagccctcttcaggg

SEQ ID NO: 1912 - DNA, 700 bp, Homo sapiens
tgagttctaggcagcaggtcagacaagctgcagattctatggcttctccagctctcccgaaagttctttaaggaagccctcagatttccttttcccctgtaatggccttggtccttggagattgctgtattgctgagaccctatcatgctggaataccaagtcataaggcagtcacagggtctggaagccctcttcagggtggggatgtgtggtggccaggtcacacatcacccctgccctagtggccttcacgtatttactgcacacccatcaggtgtctgtgctgctgggaataatcagactgcttatttcatgcattcttcttctctgcataagtacgtattgagtactcagggatgggtccaggtatcatccataagggcagaggctgtgtctgtcttatttatttgtgtctctccagcaccccgcagagaacttggcacacacaaggcattaaaaaacatttgctattaacaacaccacagttacaggaattattatcttagcttaccctttggacatgacccagagggacgcagggagggcataagggggcttaggaaggtgaagaattctgcttctgttgccttcgaggccacacccagtggctcagggcacgatgcccaggccttctgtatgcagccaggtctgtccaaggtcaggagaagtcactgtgctctttcctcaatgggcaggcag

SEQ ID NO: 1913 - DNA, 700 bp, Homo sapiens
atcttagcttaccctttggacatgacccagagggacgcagggagggcataagggggcttaggaaggtgaagaattctgcttctgttgccttcgaggccacacccagtggctcagggcacgatgcccaggccttctgtatgcagccaggtctgtccaaggtcaggagaagtcactgtgctctttcctcaatgggcaggcagggctggcaggctccagcaggagcagacacccttgggaatgctgttgggcctgagcctagaataagagggaaggattgggacaagaacaacctcaggctaagggtgaggtcaacctggaggacaatccaggagagtgcccagaattgatgtagccctgagtggggaggtgcggtggagctgatgaggcagcccatatttgaggataccttcccgtgaggccctgggggctagccagagagctcagctgctgacccgctcctccctggcctggtggcctcaggtctctaggtagagtctgctccattctggctcagctcctggaggccaagacatctctccttcaaggcccagccccctctccccagccaagagcctggattccaaggggatctaaagccttgcttgggagttccatcttcctggaatgcccagtccacagtactgaccactccagggcctcagcaaacagccagagagaactttagatgccttcatttcag

SEQ ID NO: 1914 - DNA, 700 bp, Homo sapiens
ccattctggctcagctcctggaggccaagacatctctccttcaaggcccagccccctctccccagccaagagcctggattccaaggggatctaaagccttgcttgggagttccatcttcctggaatgcccagtccacagtactgaccactccagggcctcagcaaacagccagagagaactttagatgccttcatttcagtgtgacctgtctggtccagctccacccagatgtctgctctcttagaagcctgctggtcaaggccaggaactcgaatggtggagaggaagcagtctgtggtgggcacagctggatagagggggcagcgtgggtctcctgcagggctagaactgcgccttagagtgacagggagttaaggcaggcccactgtaggcaggggtcaagggctctgcaaggggtagaggcagccacaggcatgggcaccaggcaacatccaaaaggaaggtctgagacagtacagcctgtgaggtgggctgggggctgatgcccagcatatcctggaaggacaggactcagtcaggaggcaacaaaactggtcctggagccgtggttggttcagcagaacacacaggggagggcgtgcctgtggcaaagggcgtttcccagctctagttttgtgccattcaatccctcaacaaacacttattgagtgcctgctctatgtccagcccagacctggt

SEQ ID NO: 1915 - DNA, 700 bp, Homo sapiens
ctgatgcccagcatatcctggaaggacaggactcagtcaggaggcaacaaaactggtcctggagccgtggttggttcagcagaacacacaggggagggcgtgcctgtggcaaagggcgtttcccagctctagttttgtgccattcaatccctcaacaaacacttattgagtgcctgctctatgtccagcccagacctggtcaactaaccttggagtgtggtggggattctccaagctgccacacctctctaggggctgagatgctggaggctccagagggggtcagtctctgaggatccaaacagggacaaagctggctctgccaactgggacccagttactggccctgagccagattccagggcggacacaagagcagaaccaactctcttcaggaaactgagcctgggggaggtgtgtgaccaccacacgctcacacagtttcaagtggtaggtctggggttttagaccctgtgttggtgcctttgtgccatgtgccttgccccagggacagatgtgtctcagctggacctgcagtccccatcagcacccctgtcagacctgctctttctctgttttcacagagaaaaccagtctgctctgggacccaacaaaggggttgccaggcagcagggcggggacaggtttacctagctgggcccagagaggccctggccctgaggcctgggtgtagaaaggt

SEQ ID NO: 1916 - DNA, 700 bp, Homo sapiens
tgccccagggacagatgtgtctcagctggacctgcagtccccatcagcacccctgtcagacctgctctttctctgttttcacagagaaaaccagtctgctctgggacccaacaaaggggttgccaggcagcagggcggggacaggtttacctagctgggcccagagaggccctggccctgaggcctgggtgtagaaaggtgttgggaggagtggcatctcacacggtgggggtggggggggtgggagggggaaggcagctgacaggtgggagagccagaggtggctcagcgcagccccagcagggaagtgacagaacaggctgtttgtggtggcagcgaggcccatgtgatggagccttgtgcaactggggcctcaggaaggcagcttgcaaaagcatcacagcctcacctctgcctcaaggagacccccatcctttcacccctcccacttctcattcaggccagaggattcgggcagcctgccggccatcccttagtctcccccagcatcagatgtcccaagtctacctgtagtccataaatagaggcccaacccaggtgtcttcaggtttccagtttctcctgacagctggagccttcccttagtcttgcctcttggtgtctgtgaggagaaggtgcctccatttacaaatcagctcctccaggcagagcagcagagggattgcagagcaactgtacc

SEQ ID NO: 1917 - DNA, 700 bp, Homo sapiens
cccccagcatcagatgtcccaagtctacctgtagtccataaatagaggcccaacccaggtgtcttcaggtttccagtttctcctgacagctggagccttcccttagtcttgcctcttggtgtctgtgaggagaaggtgcctccatttacaaatcagctcctccaggcagagcagcagagggattgcagagcaactgtaccatgtgctcattctacgccctggacctagaatgtcttggccgtggcctgaccatcactgtgcctggacaaaagcaggggtgtaaaaacctttccttctcagcccgagagagagagacgctgctataaggtgcaggtaaggcttgagcaaaagtgcagggttgacaagaaggagacggacatacatgcagcccagaaattcagttactggggctctccagacatactctgtcactcatctgtcagctggggcctggactcatggcccagctttagccctgccccagcgcacacatccacagacactcaaatttagcagtgacctggccaggactgtctggtctctggcctgaggcccctccttctcttcttgaccactagaactgacatccagggctactcagaaggcaggagaggcccatgctacttccatatttcttcctcccatccttctttttttttttttttaatagcagctagaacgagcttggagcactttcata

SEQ ID NO: 1918 - DNA, 700 bp, Homo sapiens
cactcaaatttagcagtgacctggccaggactgtctggtctctggcctgaggcccctccttctcttcttgaccactagaactgacatccagggctactcagaaggcaggagaggcccatgctacttccatatttcttcctcccatccttctttttttttttttttaatagcagctagaacgagcttggagcactttcatatttctacgttcccaataaaataaaaaaggaagaaatgtgaaaatagtgtttcaagaattatggcatttgttacttctgctttgtttatttattcatcagatatttttgagagcctcctatgtgtcaggcactgttttaggcctcagtgttaaactattaagttttatttatttatttacttatttatttattgttattatcttttaaaaagagacggggtctcactatgttgtccaggctggtctcaaactcctgggctcaagcaatccaaccaccttggcctcccaaaatgctgggattacaggcatgagccactgtgccaggccttaagtctttataatacatatttaaaatggatagcctcatttggaaataacttcaaagatttaaattccagtcttcctggttcttcgtctcaggagggacccccataactcctgatgcccatgattttctcactggtatagattagacctctgtctcttgatcctgaggggtcc

SEQ ID NO: 1919 - DNA, 700 bp, Homo sapiens
acaggcatgagccactgtgccaggccttaagtctttataatacatatttaaaatggatagcctcatttggaaataacttcaaagatttaaattccagtcttcctggttcttcgtctcaggagggacccccataactcctgatgcccatgattttctcactggtatagattagacctctgtctcttgatcctgaggggtcctgggggctgtgattcagattggcagaggtggtgaagctctcctcaggagtctggctagcataggcctgtcgctagcctatcctccctgccccatcctttctatctcttacgattggccctctcccctgcagtgccagctcctttagtcactgattggtcttggtgaagtgccctgccccgtggtgcccagcactgcccagtggtgactgagtcacaggctggcggggactgttcaggctgacctcacctccaggcctggccataggacgccagctgtggccactgggtatgagcctggccgcctgtgttgctgggagagtcaggcagagccatgtcgccgagtccagtagctgccagctggccgagaggtctgggaatccaggtgcagggggccatagggattaaagtcggaagagccagatccaggcctgtgagggtgaagctgggctgaggttgctggaggctcttgagagaatggattggagcagggcccatgagtc

SEQ ID NO: 1920 - DNA, 700 bp, Homo sapiens
gcctgtgttgctgggagagtcaggcagagccatgtcgccgagtccagtagctgccagctggccgagaggtctgggaatccaggtgcagggggccatagggattaaagtcggaagagccagatccaggcctgtgagggtgaagctgggctgaggttgctggaggctcttgagagaatggattggagcagggcccatgagtcagcctcatgtcctgggtggctattttcttggcttctaagaaaatcaaaattctttctcacttcccctcccaagactaggtccatagctgtgtagattcaggatcagcagtgtggagttggaggcagagctttcattgggagtgggactgaaatcctcacaccctgcatctctcatacccacccgcaatggtaagagcattcacaggacttgagcttccagcaagaggatgcctgatcaaattgtttgccccctgtgaaatcaccatattaatgggaagataggcttgcttaggaacaacggagtttgtgcctctcctgcaggagaaaccaggagctctaagagaatgtataatgagaacttctatgtgtggagagttaaacaagaagctgtctcatcccagggaagatgaacagaaaatggcggatctgggcttgaagtgcacacagtgttggaaaaggccccacctaaggctctaggaccagcagtccctgagaagtag

SEQ ID NO: 1921 - DNA, 700 bp, Homo sapiens
gagtttgtgcctctcctgcaggagaaaccaggagctctaagagaatgtataatgagaacttctatgtgtggagagttaaacaagaagctgtctcatcccagggaagatgaacagaaaatggcggatctgggcttgaagtgcacacagtgttggaaaaggccccacctaaggctctaggaccagcagtccctgagaagtagctgtgtgtaggattaagacaagctgactgcggagagctgtgacattgggcattcaagcatgaagcattgttggcccagagagggtgcacaagcattctccctcagagaaccatggtgttccagagccagagagagatggagagcttccacaatccttgtgaagatctgttatcctaacaccaatatatcccctttaagaaaatggtggccccctgtaaattgtcaatatagcaaattggctcccataatatattgaaacactattaccaccttggggattctttttcaaattacaagcttgatttaatataaaacgtaatgattaatacattagattaaaagaagaaaggaatcttgtaattatctcaaaaggcattgacaaaattcatcagccattcacacgataaaagttagaaaaccatgaagagaggaaatgttcttcacattttaaagaacagatataaaaaaccaaaagccagcattagatttaacagtctaga

SEQ ID NO: 1922 - DNA, 700 bp, Homo sapiens
  misc_feature (1)...(700): n = A,T,C or G
gatttaatataaaacgtaatgattaatacattagattaaaagaagaaaggaatcttgtaattatctcaaaaggcattgacaaaattcatcagccattcacacgataaaagttagaaaaccatgaagagaggaaatgttcttcacattttaaagaacagatataaaaaaccaaaagccagcattagatttaacagtctagaaagttctattaatgggagaatccaatgtcctcttcactactgttgttcagtgttgctctggaagtcctaaccaggacaatagggtgaaaagaagaaataagggagaagtaaaggaagtaagtaatagagtcaaaatgatcattatttgcagatattatgattttcctttcataatatccaagagaatcaattgaaaaatgattatgaccagtaggagaatccagtaggagggagcagagtagaataaattaatatatgtatatagattttaatagcttttaagagtgctaagtcacaactgattggaaaatgtgatgaaaacaatttaccattcacgataatggtgaaacattaaaaatatctataaatgaattttgagtacatcaaaagcctataaactcttttcttttttatttcctttttcttatactagtggtggtgagaacanagggcctatgaactttgatctatgatatatttaaaagaagacaanangtgtg

SEQ ID NO: 1923 - DNA, 700 bp, Homo sapiens
  misc_feature (1)...(700): n = A,T,C or G
gattggaaaatgtgatgaaaacaatttaccattcacgataatggtgaaacattaaaaatatctataaatgaattttgagtacatcaaaagcctataaactcttttcttttttatttcctttttcttatactagtggtggtgagaacanagggcctatgaactttgatctatgatatatttaaaagaagacaanangtgtgcacgcgtatgtcatgtgtctataaaaatcantatttttaatttattagtaaattcaatgcaattccaaacaaaatttgtgtgggggggaggaattgacaagatgattctaaggatcaactgaaaagtaagtatgaaaaaaacccacaaatattggattaagagactaataaagtaagatttgccctataagaaagtatgcaatagagctaaaataattaagaatgtgatagcagcataggaaaagacgaatatgttagtggaacaaaagagagtccatagcatgagataaagaaaacattttaattcagggaataaaaggtagtttactcaataactcatgttggggccatttactattatgcataaaaaataaggctataattctatatgctatataatttcccacattataaagtaaatcccaaatggattcatgatctatatattttaattttcccaatgtgaatgcttttataaactactcatatgctttaccaga

SEQ ID NO: 1924 - DNA, 700 bp, Homo sapiens
ttaattcagggaataaaaggtagtttactcaataactcatgttggggccatttactattatgcataaaaaataaggctataattctatatgctatataatttcccacattataaagtaaatcccaaatggattcatgatctatatattttaattttcccaatgtgaatgcttttataaactactcatatgctttaccagaaatgactggtaaaaaaatatatagattaatatttttataatcatggtgctacggtttgaatgtgtcccccagagttcatgtgttggaaacttaatctacaatgcaacagtgttgagaggtgggctcttacgaggtgataaggtcatgagggctctgcccccaatggattaatgccaacagaggtgggtttgttattgtgggaatgtgtccttgtgaaggaggagctcggtccccctttgtctctctcaccctctagccttctgccatggaataatgcagcaagaaggcccttgaaagatgctggcaccttgatattggacttctcagcttccagaattttgagaaataaatttcttttctttataaattactcagctattggtattctgttatagtaacttgaagcagactaagacttgaggtgagaaacatctctttcgtgaagataaatacttgaaatatgttttcctgttacatatagatttcaaaaatcagagaaa

SEQ ID NO: 1925 - DNA, 700 bp, Homo sapiens
ctggcaccttgatattggacttctcagcttccagaattttgagaaataaatttcttttctttataaattactcagctattggtattctgttatagtaacttgaagcagactaagacttgaggtgagaaacatctctttcgtgaagataaatacttgaaatatgttttcctgttacatatagatttcaaaaatcagagaaatatgctgcaaactgttggtagtttttgtttctggggatggtattttgggacatttactttttctgagttatatatttgtacagtgttttaatttcatataaataaattttactgtttgtaattagaaaaatgaagataataaaaaggaaaataaagacaacagaaggacaaatactgcttcttatgtaagaaccttacaataatacacttccatttacttctcccttcttttttgctaatgttgttgtgcgtttacctctgtatttgctataaactccataataaatactcattatttttgctttaaacagtcaactgtcttttaagtaatttaaaaaacaagaaaacctattttctatttacttgttaggtttactggtagcacttgttcttttgtttagagctgaatttccaacaggtatcaatgagccacctcagcagagaaatggcttatttcccttcagccttaagaacttcctttaggccatgtgcggtggctc

SEQ ID NO: 1926 - DNA, 700 bp, Homo sapiens
gctttaaacagtcaactgtcttttaagtaatttaaaaaacaagaaaacctattttctatttacttgttaggtttactggtagcacttgttcttttgtttagagctgaatttccaacaggtatcaatgagccacctcagcagagaaatggcttatttcccttcagccttaagaacttcctttaggccatgtgcggtggctcatgcctgtaattctagcactttgggaagccgagacagacggattgcctgagctcaggagttccagaccagcctaggcaacaacagtgaaaccctgtctctactaaaatacaaaaaattagccgggcatggtggcgtgcgcctgtagccccagctactcaggtggctgaggcaagagaatcgcttgaacccaggaggcagaggttgcagtgagctgagatcgcaccactgcactccagcctaggaaacagagtgagactccgtctctggaaaaaaaaaaaagaaagaaaaaaaagaacttcctttaacatttccggtagtacagacggactggtgatgaattctgtcagcatttttttaagatcccgaagtatttttatttttcattccccaccctgtcccccaaccttttttttttttttttttttttttttggagacagagccttgctctatcccccaggctggagtgcagtggcacgatcttggctcactacaacctc

SEQ ID NO: 1927 - DNA, 700 bp, Homo sapiens
ctttaacatttccggtagtacagacggactggtgatgaattctgtcagcatttttttaagatcccgaagtatttttatttttcattccccaccctgtcccccaaccttttttttttttttttttttttttttggagacagagccttgctctatcccccaggctggagtgcagtggcacgatcttggctcactacaacctctgactcccgagttcaggtgattttcatgcctcagcctccctagtagctgggattacagacacctgccaccacgcccagctaatttttgtatttttagtagagacggggttttgtcatgttggccagacttgtctggaactcctgacctcagctgttccatccgcctcaggctcccaaagggctgagattacaggtgtgagccaccgtgcccagcctctcattccccttttaaagataacttctctggatatagaatactaggttgcttttttttctcatagattatttaatatttaatatataattcctataattttattgttttctgtcttgcattactcctggtaagaaataaatggtgattctaatcgttgtttcccttatgtaatgtgcctatattcttttatcacttctaagatgttctatttggttttaagattttgactatgatgttcctagatgtagttcccttgtttttatcttctttggagttttaaaac

SEQ ID NO: 1928 - DNA, 700 bp, Homo sapiens
ataattcctataattttattgttttctgtcttgcattactcctggtaagaaataaatggtgattctaatcgttgtttcccttatgtaatgtgcctatattcttttatcacttctaagatgttctatttggttttaagattttgactatgatgttcctagatgtagttcccttgtttttatcttctttggagttttaaaaccccagcttcttgggatggtgtattaataattttttaaatcaaatatagaatttcatttaccatttaaaagaattttttttgccccaatctctttctcccctttccttctgggactccaattttatgtatatattagattacatgatactgtttcaaggtcactttgttgaggctgtgtttgtatttttcagtccttttacttttagatgttttccatagtcttgacttcaagttcattgatcttttcatttgtagcatccagtctactcataagtttatctagtacattttccattttgtatattgtatttttcaattctagaattttcattcagctccttttttatagttttcatttctctgctgagatagctcatctgttcatttattatctctatcttgtaatttaaacttctttaacatatttataatagctatttaaagtcctcatctgctagttccaatatctgtgttacctctggatctatttctgttgatta

SEQ ID NO: 1929 - DNA, 700 bp, Homo sapiens
atattgtatttttcaattctagaattttcattcagctccttttttatagttttcatttctctgctgagatagctcatctgttcatttattatctctatcttgtaatttaaacttctttaacatatttataatagctatttaaagtcctcatctgctagttccaatatctgtgttacctctggatctatttctgttgattattttttgtcctggttatgaatcatattttcctgcttcttcatatgtttagtaatgtttgactgtatattaggaattgtgaatacttcattgttaagagtttggatcatgtttaaagagtgttgagtttgttttattagatagtaaattcactagaggctcaatttgagcctgaggcttggttttaggctttattatggcaggtctaagatactgcgtattacaggcacagagtagccctattcttaaagcgtggactttcttgggttttcattgagtgctcagggtgttcaacaaagtcttttcaccttgttgatcagaacagatctcagaatcatgagccctctagaatccccacttagttcttagacccagagaagttttttttgtgtgttttttgtttgtttgtttgtttggttgttgtttttaatccactaggccttatggaatcttgctctgcatgtgaggcttagacaaagcctcaggagcacctctgtatagc

SEQ ID NO: 1930 - DNA, 700 bp, Homo sapiens
tttcaccttgttgatcagaacagatctcagaatcatgagccctctagaatccccacttagttcttagacccagagaagttttttttgtgtgttttttgtttgtttgtttgtttggttgttgtttttaatccactaggccttatggaatcttgctctgcatgtgaggcttagacaaagcctcaggagcacctctgtatagctttccagagctccttctttgtgtagctccttcttctttgataccttatcccacaaatttcagccacctcagcgtctgctatctatgatctttgtctccttcacatgatgagaccattgttctctctctctctctctctttggagacagggtctcactctgttgcccaggctggaatgcagtggcacgattatggctcactgcagcctcaacctcctggcctcaagtgatccttctgcctaagcctctggagtaactggtactacaagtgtgcaccacaatgcctggctaattttttaacttttgtagagacagggtattgctatgttgcccaagctggtctcaaactcctggcctcaagggatcctcccacctcagcctcccaaagtgctaggattacagacatgagccactgtgcctggtgccattgctttctgggcaccacttccttatgccatggtttggaaagtatcctaggcaaagcactttcccttttgtttcc

SEQ ID NO: 1931 - DNA, 700 bp, Homo sapiens
tttgtagagacagggtattgctatgttgcccaagctggtctcaaactcctggcctcaagggatcctcccacctcagcctcccaaagtgctaggattacagacatgagccactgtgcctggtgccattgctttctgggcaccacttccttatgccatggtttggaaagtatcctaggcaaagcactttcccttttgtttcccttctctcaaggacaaaggctatttgatgttcaatgcctataatcactggctataaatatttcgagttttatggttgtttacagtggggagggaagtttattaccaacttatcagttatggttggaacctaaggaaagtttgaaaactaaaagaagaaagaaaaggaaaagaaaatagggacccttaattcaagatgtggatctgatgtcataaatgtctaagagtctgagcttcatctcaaagcagctgggccagttgagcataccctgctgtagttctttctaacctggcatcagaattggactgaataaaatgtacagttctggccactatagcaggttgtgtcagacttatccttctgctgaaaacaactataaaagttggacaaaatgtataaaacaactatttgaaggcatttgagaacaaccaatacagctaagaattgaggagttgtgatcctggagaaaagggaataatgtgtagtgagttccacatttac

SEQ ID NO: 1932 - DNA, 700 bp, Homo sapiens
tggactgaataaaatgtacagttctggccactatagcaggttgtgtcagacttatccttctgctgaaaacaactataaaagttggacaaaatgtataaaacaactatttgaaggcatttgagaacaaccaatacagctaagaattgaggagttgtgatcctggagaaaagggaataatgtgtagtgagttccacatttacctttgctttttccctaggggcatttcacacattgttacttgagggaatagggaccaggcagaaagcatcagtcttaccagactgaggatacaaaggtcagagttcagggctgccgaagaagatggaaattaagaaggaaaattccagaaggtaggaaagaagagagaaggagcccaataattgcatgcaaattcctccaactttattggcttttttttgagacagggtcttgctttgttgcccaggctggagtgtagtggtgtgatcttggctcactgcagcctccctcaacctcctggattcaagccatccttccacgtcagcctcccaagtagctgggactacaggcacatgcaatcatgcctggctgactttgcttatttttttgtggagatgaggtctcactatgttgcccaggctgggcttgaactcctgggctcaagcaatactccagcctgggtctcctaaagtgttgggattacaggcatgaatcaccatgc

SEQ ID NO: 1933 - DNA, 700 bp, Homo sapiens
  misc_feature (1)...(700): n = A,T,C or G
ttcaagccatccttccacgtcagcctcccaagtagctgggactacaggcacatgcaatcatgcctggctgactttgcttatttttttgtggagatgaggtctcactatgttgcccaggctgggcttgaactcctgggctcaagcaatactccagcctgggtctcctaaagtgttgggattacaggcatgaatcaccatgcccaccctattggcctacttttagcctatcaggctaaagaactgagcaaattgtagtagtcttaaagtgttggggagacaaattggaattcaacttctatcaaggtagagaggccttggtaaatgcgtaggtgttctgctaagtcccagaagggtcacacactaggagagagggtcacatcctaggaataagagatatgtcctaggacaaaaaagaaccacaccagccaaaccatgacataaaccaaagccttgacaggagtagggtatttatttggtactctgccttccagaagtcaacttaattctctctttctggatgaatacaacatcacccagagactttccaacttttcatccaaaatgtgtgtcatctaatagagaagtatgagacatgctaaaaaacaaaacaaaacncaaacaaaaaaacagggccaaatgactaaaaatcaagagaaaaggcagacaatggaaatagacccacaggtgtttcagaaatgag

SEQ ID NO: 1934 - DNA, 700 bp, Homo sapiens
  misc_feature (1)...(700): n = A,T,C or G
taattctctctttctggatgaatacaacatcacccagagactttccaacttttcatccaaaatgtgtgtcatctaatagagaagtatgagacatgctaaaaaacaaaacaaaacncaaacaaaaaaacagggccaaatgactaaaaatcaagagaaaaggcagacaatggaaatagacccacaggtgtttcagaaatgagagacttccaataattatgatgaaaatgttcaagaaaatagagggaaagtaaaaaaaaaaaaaagatgaaaagctagagaatttaaatatagaattgccagaatactgataaagatagcagataggaggcaggactagcttgcagctcctgctcagacaaacagagcagtgtgtggagactcacatcctgaacttttgctccaagaactactgcaggaacataccaggaaagccaagagaatccacagaccctttgaaggaactggatcactactgcaggctcctcgagatgcaaaaaaactgtgagtctgcatgttttctcagcagggagggtcatggtctgggacaagttctcagccctgggcactggctacctggaaatagactcagtactgttgtggggccatggtgggagtgagattggcctttaggactgtgggttgcacaggagcagggtgaggcctgtgactgccagctttctcccacttccctggcaaacct

SEQ ID NO: 1935 - DNA, 700 bp, Homo sapiens
tgtgagtctgcatgttttctcagcagggagggtcatggtctgggacaagttctcagccctgggcactggctacctggaaatagactcagtactgttgtggggccatggtgggagtgagattggcctttaggactgtgggttgcacaggagcagggtgaggcctgtgactgccagctttctcccacttccctggcaaacctgtatgactcagcagaggcagccacaatcacccccgggagtataactccatcggactgggaacaacacccctatcccccacagcagctgcagcaagccctggccaaagagaggctgagctctgaaatgcatatccctgcccccacctgatggtctttctctacccaccctggtagccaaagacaaaggtcataatctcttgggagctctatggccctgcccaccgtcttaaccaggtgtccctagggcaaatttgcattctccttataggactgcagcagatgtgctcttgaaagcaccacctcctgcatggaggccaaccaacacaaaaccaagtaccctcacagagtccatttcactcccctgctacctccacaggagcaggtgctggtatccatggctgcaatacctgaagatggatcatatcacaggactctgcagacactccccagtaccagcctgtagcccagtagctcagctaggtggctagacccagaagagc

SEQ ID NO: 1936 - DNA, 700 bp, Homo sapiens
ctcctgcatggaggccaaccaacacaaaaccaagtaccctcacagagtccatttcactcccctgctacctccacaggagcaggtgctggtatccatggctgcaatacctgaagatggatcatatcacaggactctgcagacactccccagtaccagcctgtagcccagtagctcagctaggtggctagacccagaagagcaaaaacaatctctacagttcagctctcaggaagccccattcctaggggaagggggagaacaccacatcaagggaacaccccatgggacaaaataatctaaacaacagcccttgaattccagacctgccctctgacatagtctacctaaatgagaaagaaccagaaaaacaattccagtaatatgacaaaacaaggttctttaacacccccaaaagatcataccagctcaccagcaatggatccaaaccaagacaaaatctctgaattgccagaaaaagaattcagaaggtcgattattaaattaatcaaggaggtaccagagaaaagtgaagtcctacttaaataaatcaaaaacatgatacaggatttgaaaggaatagtgtcaatagggatggtagcagttcttctttgaatgtctgatagaattccacagtgaatccacctggtcatggattttttgttgttgttggcaattttttttttttttttttttttaagag

SEQ ID NO: 1937 - DNA, 700 bp, Homo sapiens
attaatcaaggaggtaccagagaaaagtgaagtcctacttaaataaatcaaaaacatgatacaggatttgaaaggaatagtgtcaatagggatggtagcagttcttctttgaatgtctgatagaattccacagtgaatccacctggtcatggattttttgttgttgttggcaattttttttttttttttttttttaagagatggagtctcgctctgtcacccaggctggagtgcagtggtatgaccttggctcgctgcaacctccgcctcccaggttcaagcaattctcctgcctcagcctcccgagtagctgggactataggcgcccgccaccatgcccagcgaatttcttttgtattttagtagagacggggtttcaccatgttgcccaggctggtctcgaactcctgagctcaggcaatccgcccaccttggcttcccaaagtgctaggattataggcgtgagccaccgtgcccagccagcaatttttaaaattaccatttaaatctcactgcttgttatcggtctgttgagagattctatatcttcctagtttaatctaggagggttgtatatttccaggaacttaaccatctcctctaggttttctagtttatgcatgtaaggtcttcatagtagccttgaataatcttttgtatttctgtggtattgaagtggcttcattgtctggggaaatac

SEQ ID NO: 1938 - DNA, 700 bp, Homo sapiens
atttaaatctcactgcttgttatcggtctgttgagagattctatatcttcctagtttaatctaggagggttgtatatttccaggaacttaaccatctcctctaggttttctagtttatgcatgtaaggtcttcatagtagccttgaataatcttttgtatttctgtggtattgaagtggcttcattgtctggggaaataccctaggttcgtcttgcactgagaagattaacaacacagacacacacacgtgaagcaggttaaggaggggaaagtttaatagacaaaaaagaagagagagtgagctttctcatacagggcaggtgggatgcgatccattttatagagaggcttgaggaggcggtgtttgatttacacaggggccaggggattggtttgaccaggtgtaaatggttacatagcccgagaagaaattggccatcccaccttaatcttttattatgtaaatgtgacctctacctgtccggtgccatttgaaccttgattcctcattgtaccacacataaaattaatttaagatggatcatagactgaactatgaaacaatcaagcttctaaaggaaaccatggaagcatagtttcatgacctctgggtagggaaacatttcttaaatgggacatagaaagcactagccaaaatataaaagattaatatgttggatttgtaagaattaagaactt

SEQ ID NO: 1939 - DNA, 700 bp, Homo sapiens
tgattcctcattgtaccacacataaaattaatttaagatggatcatagactgaactatgaaacaatcaagcttctaaaggaaaccatggaagcatagtttcatgacctctgggtagggaaacatttcttaaatgggacatagaaagcactagccaaaatataaaagattaatatgttggatttgtaagaattaagaacttttatttatcaaaagatcctattaggagaatgaacaagccaaagcacagattgagagggaatatttgcaatacatatatccaacaacaaactcatatggagaaaatatatagacttctacaattcagtgaggaaaatgcagaaatcccaataggaaaatggacaaggacttgaacagtcatgtcacaagaaataactaataaacacctaaaaagatgctcaatatcaccagggaaatgttcttttaaattgcaatgagatattgctacacacccaccaaaatgactgaaattggaaaagctaacaataacaaatgttgacaaagatatgaagcaactggaactctcattcattgccattgggaatgtaattttgttcatccatttagaaaaatggtaatatctacaatagctcaatatatgcatgtcttatgacctagggatttcactcctggatttttattatatttaaataagtgcttgtgcccaccaaaagacatgtg

SEQ ID NO: 1940 - DNA, 700 bp, Homo sapiens
aacaataacaaatgttgacaaagatatgaagcaactggaactctcattcattgccattgggaatgtaattttgttcatccatttagaaaaatggtaatatctacaatagctcaatatatgcatgtcttatgacctagggatttcactcctggatttttattatatttaaataagtgcttgtgcccaccaaaagacatgtgcaaacatatacaaaacagttttatttaacatgactaaaaacaacccaatgttcatcaacaaaaatggataaattgtgttatattcaaacaatggaataccacatagcaatgaaaaagaatgaggaactattacaaacaagatagatggatatcacaaccataatgtggagtataagaagccgacccgaaagaatatatattgtataacttcacttttataaagttcaaaatctgacaaaactaatcaaaagtgaacaaagaaaaaatagtgcttaactttgggagagtttactgactatgaaaaggtacatggaagccctctggtattctggaaatagtctatatttttatgtgggaggtaattatgtgaatttatatgtaagcaaaacacattgagctgtatattcagacatgtttagtttactgtatgttaactgtatcttaataagtaagtttttaaacaaaagcacactggctgcccatgcctctctacccctgct

SEQ ID NO: 1941 - DNA, 700 bp, Homo sapiens
aaaaggtacatggaagccctctggtattctggaaatagtctatatttttatgtgggaggtaattatgtgaatttatatgtaagcaaaacacattgagctgtatattcagacatgtttagtttactgtatgttaactgtatcttaataagtaagtttttaaacaaaagcacactggctgcccatgcctctctacccctgctagtggggattcgtgaggcccgaagagggagatactattaatagctttccagtgtatagaagatgggctcatattcgcacccctagtttatggagcagggcataccaattgcaggtcacacatggaacccattcatgcattccttcttcctctctctgcatgccactattggttccccaaatcaaagagggcttccagggtgacctgtgtgtttggccttgggggcttgtgacaataaactggggagatgcattagtgtgctaaggctgccataacaaaatatcacagcctgagtggcttaaacaatagaaattcattttctcatagttctggaggccggaagttcaagattaaggtgtcatcagggtgggttcctggtgaggcctctcttcctggcctgtagatagatggccaccttcttgctatgtcctcacatggcctcatctttgtgcaaatgtggagagatacaactctcttgtctcttcctcttcttacaaggac

SEQ ID NO: 1942 - DNA, 700 bp, Homo sapiens
aacaatagaaattcattttctcatagttctggaggccggaagttcaagattaaggtgtcatcagggtgggttcctggtgaggcctctcttcctggcctgtagatagatggccaccttcttgctatgtcctcacatggcctcatctttgtgcaaatgtggagagatacaactctcttgtctcttcctcttcttacaaggacaccagtcctattcaagtaagtcttcacccctgcgacctcacttagcctttatcagctttattaacctttttataggtcttatctccaaatgcagtcacatttaggtaagggcttcaacatatgaattttgaggctatgcaattcaatccacagaaggagctgatttactttttacacccatgtcaatttggccccctccaccccactgatctcagagcatttcctgggggtcacctcagtgtgttctgcaacaatcctctgcctctgagccagactgacagctctgccctgccacccattgctacttctgctgtccatggctctgggaggcctctgctctgctggaagtatcatctgtgtttgtcaccactggggagagatgctgtttactgttgatacccccagcccagtcccaatggtggtggggtgtatactctctcattaggcacttccctctacttcctaaacacagcaaggcccagagagggatgaggccctgc

SEQ ID NO: 1943 - DNA, 700 bp, Homo sapiens
gctacttctgctgtccatggctctgggaggcctctgctctgctggaagtatcatctgtgtttgtcaccactggggagagatgctgtttactgttgatacccccagcccagtcccaatggtggtggggtgtatactctctcattaggcacttccctctacttcctaaacacagcaaggcccagagagggatgaggccctgcctggccaccgtaggtctccgtgggaatgagccattccctctcccaggctttgctcattctatctcctctgctgcaataccattctcccagacctccaacacttcccctggctgactatgcagggagacccacacctcatcctcctacctgaccactcggcaagtgagtctccccttctgtagtctccctcagcctctgcgattcaccgtcaatttcttcatctgtgcctcctctccccccataaaacaaaacaaacaaacaaacaaacaaaaaacaacatgagctccatgcaggcagggtgtttttctgactcatctctgtgtccctgggtacccaggactggacacaagggaggtgtcaggggatgtctgttgactgactgaatgtgagtaagtgagggtgtagagggttcctgaagccctaggctgagtgaccaagtatggaaaccctgcttgccacacttcagcatgaccaaggcagctggtcttctccttcaaagg

SEQ ID NO: 1944 - DNA, 700 bp, Homo sapiens
gtttttctgactcatctctgtgtccctgggtacccaggactggacacaagggaggtgtcaggggatgtctgttgactgactgaatgtgagtaagtgagggtgtagagggttcctgaagccctaggctgagtgaccaagtatggaaaccctgcttgccacacttcagcatgaccaaggcagctggtcttctccttcaaaggcagtgctgaggcttgacaggtcatagagccaggccttcatgtctaggctgcagacagcttcctcaaagtccatctcctcttccctactgatcttttcctgctactccccattggttgaacccaaccagaagctgcagggcaggtgaacctgttgatgctatccatataggtcagcagtcagggcgcagagcaggggaaagaggagacaggagaggagatctggaagggtaagcagatgacatctgtcaagtgttaggtaacacttggtacagggagagtgctccataaattagttgtccaatcacagaagcatcccagagcatcatagaaacccagatgaggactgcccatcctgcttctctggctcttctcctccaggagctcctctccacagagccaggatattctgggtatgttcagagttcaaggtctccccatctcctttcctaacttcactgcattactagtccttggtgtttccttagggctactggctccta

SEQ ID NO: 1945 - DNA, 700 bp, Homo sapiens
atcacagaagcatcccagagcatcatagaaacccagatgaggactgcccatcctgcttctctggctcttctcctccaggagctcctctccacagagccaggatattctgggtatgttcagagttcaaggtctccccatctcctttcctaacttcactgcattactagtccttggtgtttccttagggctactggctcctatggcctgaggcttccacagcctgaggcttcccaaggctacaagtcaacttagctgaccatgaaggcccctgatcactatgggctgaggaaaggatctggggtcttcccaatatcctccctgcctcctcagccagtggaggtcccagcattggagtcattccccagggcctggaaaacatctctcccttcccgttgctcatgattatgcaggcctagtcacaggtctcagctaaaccttggcaggttggaaggatggggcaccaagtggaggggctttttgagcaaggctggggctgctcctttgagtgagccctgttgagctccatgcaccctctggtggccaacctcatttttgcaactacagctctggacaagaaggaagcagctcccctaaaaagattctcccagaaggcctcacacacctttgccctgggacaaaaatagctgttggtgccccaggagagagtgcagagaaaattccagaacttgatgagggcagg

SEQ ID NO: 1946 - DNA, 700 bp, Homo sapiens
tttgagtgagccctgttgagctccatgcaccctctggtggccaacctcatttttgcaactacagctctggacaagaaggaagcagctcccctaaaaagattctcccagaaggcctcacacacctttgccctgggacaaaaatagctgttggtgccccaggagagagtgcagagaaaattccagaacttgatgagggcagggtgtcaacctggcctacagctgttgggtgaccactggtgtcaacctggcctacagctgttgggtgaccactggggtgagagggcagtacttgcccccaaaattgcagccaccaatgacagcatctaacgacccagccagtttgaggaagccatctttccaccttcaccaccttgatcattcactcttcagccaagaagatgtactgtccaagccatcccttctcccatgggctctgatttctacagatgatagaggtagacatcttcctgattccaagtctgcaactagctggttcagggtcagagtaagtaataaggccagagcctggtccaaagtcaatatcaggctctggttcagagtcaagattaagggcagagccagaggacaaaggacagaacctcctccttctcatgtgaaaggccagatccacacgcttgcgtatgcatgtgaatccctctgtgcgtgagcatataaatgtgtgtgtgtgtgtgcgtatgtg

SEQ ID NO: 1947 - DNA, 700 bp, Homo sapiens
tcagagtaagtaataaggccagagcctggtccaaagtcaatatcaggctctggttcagagtcaagattaagggcagagccagaggacaaaggacagaacctcctccttctcatgtgaaaggccagatccacacgcttgcgtatgcatgtgaatccctctgtgcgtgagcatataaatgtgtgtgtgtgtgtgcgtatgtgtgtgtgtttgtgggtgagagccctcttactagaggctatggccaagttgctctgtttttcaggcactagaagctcagggattatcaagcttctcacaggtttatgcaaatgtttgaaacatgaaaaaaatatagaaagctataaaaaatgtaaatactaaatatagtaaatgttaacagtatgtcatagtcatagtcaactgaagttcagccatgttcttgtgtggtcaagtttaaaatgtatttatgtgggatgtgggtgtgtggaataggtttgatgtggaatgaggtagtcaggacctttggaggaatgagtgccctggcctccttgtggtgggtaagagtcccagggcagtgtactgcagggccacaaggcagggctgactagcaagttcaaatgctggtgtctactgaagggaaggggagatcagagctgcaactggagctgacactagcagggcagttgagggcaggaaagaggccacaggagggtttagggtc

SEQ ID NO: 1948 - DNA, 700 bp, Homo sapiens
tttggaggaatgagtgccctggcctccttgtggtgggtaagagtcccagggcagtgtactgcagggccacaaggcagggctgactagcaagttcaaatgctggtgtctactgaagggaaggggagatcagagctgcaactggagctgacactagcagggcagttgagggcaggaaagaggccacaggagggtttagggtccttgagacaggagtgagcaggcctcagccacaccagtgattcaggcttttgtgattatgtggtagcagactgggattagggctagccactgacagctcatgtggtgattttttttttttttttttgagacggagtcttgctttgtcacccaggctggaacgcagtgtcgtgatcttggctcactgcaggttctgcctcctgggttcaagcgattcttctgcctcagcctcccgagcagctgggactacaggcatgcaccaccatgcccacctaatttttgtatttttagtagagatgaggtttcgccatgttggccaggctggtctcggtcttgaactcctgacctcatgatccacccaccttggcctcccaaagtgctggaattacagctgtgagccatcgcgtctggccaatttttttttttaattagcaaaagatactcccttttcaattcactttatttccatctactgaaaacttattgtaatgactatgcacat

SEQ ID NO: 1949 - DNA, 700 bp, Homo sapiens
tttcgccatgttggccaggctggtctcggtcttgaactcctgacctcatgatccacccaccttggcctcccaaagtgctggaattacagctgtgagccatcgcgtctggccaatttttttttttaattagcaaaagatactcccttttcaattcactttatttccatctactgaaaacttattgtaatgactatgcacatctatgatggctgccatgtaaatggagacatcattgtgcagtgcaccaattgagcaatgtttgattgggctaggatcactcatggatagattcatggacaccagtcttgctcctgaaaggatataaggtgccttacaaacaagtttcattatagcaaagtgaagtacattcatttaaaaatagagagaggcagcctgggcaacatggcgagacctcgtctctataaaaataaataaaaaattggccacgtgtggtagcgtgtacctgtggtcccaccagagaggctgaggtaggaagattgcttgagcctgggaggctgaggctgcagtgagcctctgaactccagcctgtgttcgtacactgcacttcagcctggagagagtgagacccaaaaaaaaaagtgagtctcaaaaaaaaagtgagtgagtctcaaaaaaaaaaaaaagaaagaaagaaaaaggagaggaagggtggcaccaggagagtttgtgctgaaactgt

SEQ ID NO: 1950 - DNA, 700 bp, Homo sapiens
cttgagcctgggaggctgaggctgcagtgagcctctgaactccagcctgtgttcgtacactgcacttcagcctggagagagtgagacccaaaaaaaaaagtgagtctcaaaaaaaaagtgagtgagtctcaaaaaaaaaaaaaagaaagaaagaaaaaggagaggaagggtggcaccaggagagtttgtgctgaaactgtcattaaatgtgtggttacctcgcaatgaaaggagtctcgtatttgaggaagccagacactgtgattaggattccatgtcagcctgaaacccagaagagtgctggcgtgttctctggaggcagccaattttcactctctgttcttgtactttctgggggctgccactaatttcctttagcaagggctgctctagggtaacagggctgagggggcttggatgacaagtaggacctcatccctaaaagggagctcagaatggggggcagagcattcaacaaatatttacagaataaatgaatgagcaaaggaacatagcccttcctactttacgtcaccaattcttaactatccacttctctctctattcattggcagttcccagttcaggtcaccatcagctgtcaccccgcctcagccaagctctgctcctccttctcccccactcacccacagtagaaagggtgtttttcccaaatcccaaatcttatcctgcttctccc

SEQ ID NO: 1951 - DNA, 700 bp, Homo sapiens
agcaaaggaacatagcccttcctactttacgtcaccaattcttaactatccacttctctctctattcattggcagttcccagttcaggtcaccatcagctgtcaccccgcctcagccaagctctgctcctccttctcccccactcacccacagtagaaagggtgtttttcccaaatcccaaatcttatcctgcttctcccctgcctttgctctggggtgtctgctccttgtcttcagcctcacatccaaatccttttttgtggtccatgaggcctcaggtgatctgtccctgggatctctgcagctttacctcttattactcccctactgtctgctccaccattgttccccaatcaagagcttccagggtttggccttggaggcttgtgacaataaactggggagatgtattagtgtgctaaggctgccataacaaaatatcacagcctgagtggcttaaacgatagaaattcattttctcgtagttctggaggccagaagtccaagattgaggtgtcatcagggcgggtacctgatgaggcctgtcttcctggcttgtagatggtcaccttcttgctatgtcctcacatggcctcatctttgtgcaaatgtggagagatacaactctcttgtctctcctcttcttataaggacaccagtcgtattcaagtaaggcttcacctctatgatctcacttaac

SEQ ID NO: 1952 - DNA, 700 bp, Homo sapiens
gtccaagattgaggtgtcatcagggcgggtacctgatgaggcctgtcttcctggcttgtagatggtcaccttcttgctatgtcctcacatggcctcatctttgtgcaaatgtggagagatacaactctcttgtctctcctcttcttataaggacaccagtcgtattcaagtaaggcttcacctctatgatctcacttaacatttattagctttattaaactttttataggactaatctctactggcttcctgacattttaacaaggcctgaaaaaaacattaaaaacactcaactttcagccttttagatagtagctacatcagatgcccaatagctatccttaaccctcaccttatcacctatccctaatccccacccagccccaatatagggtcaggactggggaaggaaggacgagtggctgctggactgtaataataattctaaaagtgtgctttacagtatatacatcaaaatatcagatttcaagcaccatgcctagctaactcctgccctctggacatttgcactagtccagagcctctcgcccaggatggaggtgaagtgaggaggaaagttgtagtgtaaactcactctttacaccatggggggcctgccctggacttgctgtgtaattgcagttcctgaaggtcttggcatgcctgtaatgacaactcagcctgattgctgactctgctt

SEQ ID NO: 1953 - DNA, 700 bp, Homo sapiens
tagctaactcctgccctctggacatttgcactagtccagagcctctcgcccaggatggaggtgaagtgaggaggaaagttgtagtgtaaactcactctttacaccatggggggcctgccctggacttgctgtgtaattgcagttcctgaaggtcttggcatgcctgtaatgacaactcagcctgattgctgactctgcttgtcttgggttgcaggggtccatgggggaggcaaatggtaggagagttgtagcctgctttggtttttgcacccaccagatgggttcagggattaggggggcactctctagggacacacttggtcctgcccagcctgtccccacaggcttctggggattctgccagattatctttcccttttccagggtcaaccaccaggctataagaccagactactggataggccctatttcagaagcagtagggctactactaggtagccccactcaagccacaagtcttgctgtctgtgtttggccttgagtcaaagcgccagccaactgagacacactcggtctttcctcagtctctaaggggagaaacctagggtgggttgagctccagtggacagctgcatgcggaatgtaccgaagaatacagatgtgtatccacatatacaatgccctctgtgtggcattggttgaacctgagggccttgctctgggaaattccatggaaggc

SEQ ID NO: 1954 - DNA, 700 bp, Homo sapiens
gagtcaaagcgccagccaactgagacacactcggtctttcctcagtctctaaggggagaaacctagggtgggttgagctccagtggacagctgcatgcggaatgtaccgaagaatacagatgtgtatccacatatacaatgccctctgtgtggcattggttgaacctgagggccttgctctgggaaattccatggaaggccagatagtcgtaaaccctgaccacacctccagctgctgcagtggttccagggcctgcaagagtcatcagcattcagggagacttcagtgccaagcagtggagcttgccccactccccttccccaaaacagggatcacaggtgagtaggagtggaggaggctggggcagggcaggctgagtaggcccctgtttagagttaagggctatgccacatccaccctcctattcatccaatttcctgtccgcccagcacagatgtttttactatcccttctggggaaacaccaggttcttccttcggggtggggatggcaggcagacaagtccagactgcttcaaggagccattggccagggatattgcctagggacagcatggaggtagagcctcatttggcaatgccctggccatgctggggtgaaaggtcataggccatgcctgatcttgagcctaggaagggtctctaagactgggtctaggtaggcagtacctcctactag

SEQ ID NO: 1955 - DNA, 700 bp, Homo sapiens
gggtggggatggcaggcagacaagtccagactgcttcaaggagccattggccagggatattgcctagggacagcatggaggtagagcctcatttggcaatgccctggccatgctggggtgaaaggtcataggccatgcctgatcttgagcctaggaagggtctctaagactgggtctaggtaggcagtacctcctactagtagcctttcccagctggaaaggcttgggcttttccctccctagacaaagttgctgggcgggcctctgcttatctactagtttttatactagacagagcccctttgatatgtgtggtccctgaatcccccgccttgacctcaactggtgatcagcaaatgtttgttgagtgaacacataaatgaacaccatagagctgttccagaagggaggtatggccttgttcatacaatggatttggggagaagggatgtgaatctctataacatgctgtgatgtgtggctgttaaagatggttgtggattcattaagtgacacacactgggtgtactcaatgaggtctgctagaggccacaatagtgggaatgtccactcattcattcatgtatttttgttcaccaattcctctctaggctctgggcgccagaccctatgctagagctggagacacagtgatgaacaggttagaggcagtccccaggagggccaaatggtaaatgaa

SEQ ID NO: 1956 - DNA, 700 bp, Homo sapiens
attcattaagtgacacacactgggtgtactcaatgaggtctgctagaggccacaatagtgggaatgtccactcattcattcatgtatttttgttcaccaattcctctctaggctctgggcgccagaccctatgctagagctggagacacagtgatgaacaggttagaggcagtccccaggagggccaaatggtaaatgaagtagacattgaatgaggtcaggtagcatgtgtgaaactcatccatgaggagctttggggcctatggcaggatctggctcaggctagacccagaaagccttttgaaagaaaccaccttttgggaagagaatgttctaggcaggaggaataacacattcaaaggccagggaactgaaaagtgcctggagtggctgcagcatcaagtttgaggctgtgcataagaagagagaccatcagggctggataaaagggattggcagcattggcaagatttgtgtctacccttgggtccatggaatacctttgagaggttctatacggaaataacatgatgggaatcacatggttacaatgtcactctgccctgtgtaatggagtaaggatagagggagcggagtagaaaagtgggctaagatggattgtccaagtgagagatggtggtgtcctgaatttggtctgcgacagcagggttgggaagaagtaagtgaactgagagagatc

SEQ ID NO: 1957 - DNA, 700 bp, Homo sapiens
ctttgagaggttctatacggaaataacatgatgggaatcacatggttacaatgtcactctgccctgtgtaatggagtaaggatagagggagcggagtagaaaagtgggctaagatggattgtccaagtgagagatggtggtgtcctgaatttggtctgcgacagcagggttgggaagaagtaagtgaactgagagagatccaccaggtaagatctccagggtgggcatgcagtgggaaagaaaagggaagtgactgggagatggtgatatttgctgagatgtaggaaatgctggggcagaagcagtttgggtggtgtgggctgtggtatgggggagatgtttcatcctggctgaacctgcagctggagatgccccaaaagcagtggcaggggggtccccatacgggactaccccaaaccatcctgaaatggttgggattccaaagaaagtagcactaaatgccagggtgatcagtccaaagcatttattagggaaatttctcggtctctgagggggctgcagtacatcctgtaggcagacagcgagacagggatgttctatctaggtatgcctgctgcaaggggggtctgggtatggaatttatatgagattttaaggaatttggctcagggtcggggctagtttctttcagtgtttcgggcgaccatctaaacacctttatcagtgcctgggaatgttt

SEQ ID NO: 1958 - DNA, 700 bp, Homo sapiens
tcggtctctgagggggctgcagtacatcctgtaggcagacagcgagacagggatgttctatctaggtatgcctgctgcaaggggggtctgggtatggaatttatatgagattttaaggaatttggctcagggtcggggctagtttctttcagtgtttcgggcgaccatctaaacacctttatcagtgcctgggaatgtttaaggccccagcttgggctcaagcctacaggaaaaaaccttcggctgtctgggtcatagagtggtcaaggcatttggtatttgtcaggagagagaaaaaagtgagggaacctgggggaccctacatgagacaatgagttcacttatcaagtggtcataaagaaaaggctgtgacgatgtgggtctggagtggacccaggctggagattcaaaactgagtgatagatttacatgggtccagaagcctttgagggcatggaggaatgtcaaatgtagtggattaaatggtgccccccaaccccaccaaattgcattcatgtcctactacctggatcctgtgaatgtgaccttatttggaaaaatggaccttacagatattattaagttacaggttattaagggagctgttgcagtggttccagggcctgcaagagtcatcagcattcagggaggcttcagtgccaaacctccctggattacctgggtagacctcccaatctgc

SEQ ID NO: 1959 - DNA, 700 bp, Homo sapiens
accaaattgcattcatgtcctactacctggatcctgtgaatgtgaccttatttggaaaaatggaccttacagatattattaagttacaggttattaagggagctgttgcagtggttccagggcctgcaagagtcatcagcattcagggaggcttcagtgccaaacctccctggattacctgggtagacctcccaatctgccctggattacctgggtagacgctacagccaatgacagttatttttataagaaacagaagggcagaagatgcagacaccgaggagaagtgcaggtgaagatggggcagagattcgtgtgatacagccacaagccaaggaactcctaagccaccaggagctggaagaggcaaggaggggttcgcccctagagccttcagagggagcacaccccggtaacattttgattttggacttctggcctccagaactgtgagagaataaaattctgttgacttaaggcacctagttcgtggtaatttgttgtggcaaccccaggaaatgaatagatcaggagcccagatggagtctgagggccttatgttaagggctgagtggtgaaagtgaggctacaaaggcagaggtcagaaatggtatcttctgggtggaggcaggtagaggaaaaggaatataaaaacaaatgaatggccacttcctgcaaggcaggaagaccaaggagacat

SEQ ID NO: 1960 - DNA, 700 bp, Homo sapiens
gaaatcgaggagtttccgggaaccgaaccacgctgggagcgctgaggtctgcgcagcggcgggggccgggggacgggcgggcgtccagtgttaccggccagtggccagctggaagttccagcgggagccggggaaaaccggccccggaaaagccccacctgaatgcacctgcccaggcctctccggatggtgttcatgctgagggtgggggtgtgaaggatggacctgcctgcagggtggcctttagggaatgagggaggagttctacaagctaaggggtttgagggtgtgcacgcggggaaagaggggactgtgcgcaggcaggtgggatctgaggaattgggatatcccctcaaatgactgaggtccccagctgtcccctcactgtcacatcccatcttattgtccttatacgatgaggtctccttactgagatcatatccgtagtgtcctcttttgcttatttgttggaggatttccccgaacatgacttggagcccttgagagtgagccctgactgtctggtctagtctcctggatctagaacccaccaacctccacggggggcttgtgactgtttactaagtgagaaaaggagtagggtgagttcgaggcatctgtgaggtccatatgccttctgacctgctcccccacaggacccctagcccactcaggtcctgccatgtccccagttgaagga

SEQ ID NO: 1961 - DNA, 700 bp, Homo sapiens
ttgagagtgagccctgactgtctggtctagtctcctggatctagaacccaccaacctccacggggggcttgtgactgtttactaagtgagaaaaggagtagggtgagttcgaggcatctgtgaggtccatatgccttctgacctgctcccccacaggacccctagcccactcaggtcctgccatgtccccagttgaaggaagccccactctgcagaagatgccttggcttttgtgggaggggcttcccttgtagttccctgagaactgccttccagctgggatggctgggcagaaggcggactgtagtcatcacagaggaatgctggccgtggggtcagccacttccttctctccccagggcttggagctcaggccagggattatggtgggttggccctggatctgagacaagaaggctgggagtttgggtggcagagggagagtccagtaccctccctgatctctgcagcccacagcagtacctggggtcaaggtggacagtgtcactggcaagcccatgtttcctaaatgcatgcctttgagaccacaagtctatggtaaggatctctttccttatggccctgagaccatggctcttggaaagacataaatcagactaaatggagctccctcagcccagaagagctggggctggggcaggtatcagtggtggctattctggaagcagccagctagcca

SEQ ID NO: 1962 - DNA, 700 bp, Homo sapiens
agtgtcactggcaagcccatgtttcctaaatgcatgcctttgagaccacaagtctatggtaaggatctctttccttatggccctgagaccatggctcttggaaagacataaatcagactaaatggagctccctcagcccagaagagctggggctggggcaggtatcagtggtggctattctggaagcagccagctagccagtggaaggagaggcagcaagacctccctagcatccctgtatgggccaacactgactttcaccagcccaggcttaggatcagggtggctggcctgggagagggccagggaaagtccaaatactgcaagagtggagcttgtgccatgagcgcctggcaaccctggtgactcaacctggggaatcccaactccaggggcagccctggaaatgaggctcaggacagtgaaggagtgccacggaggggcccaccaaccgtggcagcttttagtgaggccacagatcaaataggttgttgtcccttctttctcctgtggcccagggttagaaacagtgatgctggtcctctgcccggtccaaatagtatttttgatccagggaatccaactctaatcctagcccataaatttgacctggcagaggacctggtcctcagaatgtctgtgttgggctccatttgatgttacatcttagaaatggtagatgtagctcaagctaataaat

SEQ ID NO: 1963 - DNA, 700 bp, Homo sapiens
ctttctcctgtggcccagggttagaaacagtgatgctggtcctctgcccggtccaaatagtatttttgatccagggaatccaactctaatcctagcccataaatttgacctggcagaggacctggtcctcagaatgtctgtgttgggctccatttgatgttacatcttagaaatggtagatgtagctcaagctaataaatacccacaggaatgtgtctttgtggtctggactcagcaaatgctgagttattggtatatttatggaaggaaagcagggcagagacaggagaacaggtgtccctgtgggtgctcggccctgttcactgttgtagcctcaggagccagcctcagctgagcagagagcaggtgccccatgaaccagtgtgacatggttggatggatggatggatggatggatggatggatggatggatggatggacgaacagacagatggatagataggaatatggatggtggattcagatggcctcagcagcatgcacattttccccacgatggtctttgcaataagacaatttccacagaaactggtgggtgccccagaaggaggggaggaagaatgtggcttctccaagcagcgctgtggttgtttctgccaggttctatctctccaaggggacctctgctccctttcccatagccctgttgacatgtgtggcccctcaaagtcctgcaga

SEQ ID NO: 1964 - DNA, 700 bp, Homo sapiens
tgcacattttccccacgatggtctttgcaataagacaatttccacagaaactggtgggtgccccagaaggaggggaggaagaatgtggcttctccaagcagcgctgtggttgtttctgccaggttctatctctccaaggggacctctgctccctttcccatagccctgttgacatgtgtggcccctcaaagtcctgcagagactgggagcctagtggcaagggccacccagacacagaacaggggaaaggagctgttaacattagctggctgttccattcctctcctggaaagtaggtccacaaagaaatttaggtaggacctcagccaggtgtgaaagattccagtttttttctctgcatgagtaagtccttgggaaagcatctgttgaccaattgactgattgactggcaagaggagcaaagggtcagcagagacccacctgcctggatggtgtgggagaaagcatgaccgccctccaccttgacaggtgacaaaccacagtgaatgtgtcaccacatcagatagccagcatgaattgctgcactgggagtgtttaaaggtctgggtgcataattgggagcaaaatggacaagggtatgctgggagctctaagccaggaggcctctggtggctagtcacctccaggaagcaaaagccattatttcttccttgagaatccccgtgaatattggagaggg

SEQ ID NO: 1965 - DNA, 700 bp, Homo sapiens
cagtgaatgtgtcaccacatcagatagccagcatgaattgctgcactgggagtgtttaaaggtctgggtgcataattgggagcaaaatggacaagggtatgctgggagctctaagccaggaggcctctggtggctagtcacctccaggaagcaaaagccattatttcttccttgagaatccccgtgaatattggagagggcttctcacagccccatgggctggggcatgagtgtgttatgctttgcttttagtggaggaggtgactccagaaggctaaagatttagggacagctgatggtcctggaatgcttctcagccttgggcctacgctgggccctgtgaggggacttagaagtaagcaccgtggtctccactactaacctgcatgtgagctctccaaggacagaggatgctcagaaccacccccacacccccactctggcacccagcacattgctctcaggcagtaggcacttagtaagtgtgctctgattgcagtgccagacgtatgtcatacctcgagtaagaggcaaagaggcagagatgctgggagtatggagacggagcaggttatctcagtcattgttcacagatggctactctgaggaggggacagttcagcaaagcctcaaaggatgagtcaaaggttaataggctaatagtaggggaggcattccagaatgtgaaaacagcccaagg

SEQ ID NO: 1966 - DNA, 700 bp, Homo sapiens
gccagacgtatgtcatacctcgagtaagaggcaaagaggcagagatgctgggagtatggagacggagcaggttatctcagtcattgttcacagatggctactctgaggaggggacagttcagcaaagcctcaaaggatgagtcaaaggttaataggctaatagtaggggaggcattccagaatgtgaaaacagcccaaggaaaggcttggcagctcagaagtgcagaacggatctcgcttttggtgtggcctggagtagctgccccagaagctgaggctggaccaaccagtaggggccacactctgaagagcctggatgctgtgctcaagagtggactctatcctggtagacagaggccgctcagggctggactgatgttgccttcctttctggagccaaggcccagaccagggtctatcatcaggtgtctgttgaattaaatgctagggcaggtcttgtgagggccactggtggcctgacctatgctttagaaaactttctgtggctgctacagaggattacgcctgtggcacaccagggcaagactagggtgagatagtttcctaaaggcacaacatttaaggaggtactcgctctcaggggccaaccctatacttgggtgagtctgacggtgagtagctccttaaaggtttcaccctaagcacctgccctgcctgcttgctccaccctatctggtcc

SEQ ID NO: 1967 - DNA, 700 bp, Homo sapiens
ctgtggctgctacagaggattacgcctgtggcacaccagggcaagactagggtgagatagtttcctaaaggcacaacatttaaggaggtactcgctctcaggggccaaccctatacttgggtgagtctgacggtgagtagctccttaaaggtttcaccctaagcacctgccctgcctgcttgctccaccctatctggtcccttctgcacactggaggctgggaggtagactagaggcagctcaagtgatccaggcatattagggctgtggccacaggggatagagataggcctagttgagagcagaatcagatgacaggatttgccaggacatgagactggctggagcaggacccatcccccctccctgggtgccccattctgggagaagtgtaggagaccccccactctgcctaggagtctatatgtccacagccagggccaaaacaagatcttaggccttggcttctgtcctaggttatgagtctagggaaccaaggacactaagctaaagagagtagggcagcaggtgaaaaagccacaggctgccccaggaaggcccaggccactggagaccacagctagaacctacaaccatgtcccgagactgctcggccttgccctttggatgcttgggcacagcaggaaggaagtgataagggtgcctccactgctggatggggcgtgtctgtcagtccatc

SEQ ID NO: 1968 - DNA, 700 bp, Homo sapiens
cactaagctaaagagagtagggcagcaggtgaaaaagccacaggctgccccaggaaggcccaggccactggagaccacagctagaacctacaaccatgtcccgagactgctcggccttgccctttggatgcttgggcacagcaggaaggaagtgataagggtgcctccactgctggatggggcgtgtctgtcagtccatcttccccccgctgtctgcccagcaagaccaggggccacccccaggtgctccccaggggattagcagcttggttccccagcccacacccctagaagctctgaccctatggcaacagcaccccctgctggctaatatggaaaaccaacccctttccctcctctagcaggcggaagtttaggggtcttggagaaagagaagggtgcaggcacaatgctgcgggaaagggtgggggcaggaattcaggatggactttggctatggcagataagcaggtgccacctggtaaacagagcacctatttcctgatcagtagcctttgaacagatgccagagaggccaggacacaagcaaaggcagaaatgggggtttctaaggtaactgctgagcgaggctggctctcgtgggagtccctgccttctcctacagcatcatggcccaggaaggcctgcatcctctgttgagcactgttctcctcaggtgggctcaggaactccctcagat

SEQ ID NO: 1969 - DNA, 700 bp, Homo sapiens
cctgatcagtagcctttgaacagatgccagagaggccaggacacaagcaaaggcagaaatgggggtttctaaggtaactgctgagcgaggctggctctcgtgggagtccctgccttctcctacagcatcatggcccaggaaggcctgcatcctctgttgagcactgttctcctcaggtgggctcaggaactccctcagattccccctgagcaagccacctggccccacagaggatttggcctaggactgaaggctgagagctaggcctgagacagggtagtgccccaggcaccccaaaaagaggatttgtccctaaaattcctcccgcaactatccaaggctaggaatagaggcagggacacatcagcagaacaaaatctcagagcgtccctgagcagctgcctggctcttcagatgcaaacctggttagacacacacttctcctgagctctaggcccatggctcaggcacaaggaccacctcggagtgctggatgaggtgcccagtggacagaggagtgagaggacccagtgtatgccactttgacccttcagctgtgagccaggaagtccaggcagacacagccacaagcagggccatgccctgggcagccacttcccagaaaagtttctgccgcaaaacagagagagtggccttccctgccctgcatgaccctggcacctggagtcctcacctcaga

SEQ ID NO: 1970 - DNA, 700 bp, Homo sapiens
  misc_feature (1)...(700): n = A,T,C or G
gcccagtggacagaggagtgagaggacccagtgtatgccactttgacccttcagctgtgagccaggaagtccaggcagacacagccacaagcagggccatgccctgggcagccacttcccagaaaagtttctgccgcaaaacagagagagtggccttccctgccctgcatgaccctggcacctggagtcctcacctcagataagaagccagtagttctaggagtttacttacatcatggctcttgattacagtgaagaccggggccttgncctaccccagggaaacttctctcccgggccaatggtgtggatggctgctgttctcttatgactcagtgtgggcctggtgctcaggagagctgctccttcccatgccctggatgtgagctcagcagccatcttgattcaccaggacaatgtgagctccacacaccaccctcagaccctcacctaccgggctctcagggagagatgaggcctcccggagagtccacaaagagaaaaaagcggcttggctgccaaaactgcccacgcaccccagatgccatgctcagctagcagccctggtgccacacagcctgagagcaggtgggagccatagatgcaacaagctgtcatcaggcatgggagggctgggctgccatgctgaggctggtggggtgggaaaatcaacttgcagccaccaggaagtacaggagca

SEQ ID NO: 1971 - DNA, 700 bp, Homo sapiens
aaaaaagcggcttggctgccaaaactgcccacgcaccccagatgccatgctcagctagcagccctggtgccacacagcctgagagcaggtgggagccatagatgcaacaagctgtcatcaggcatgggagggctgggctgccatgctgaggctggtggggtgggaaaatcaacttgcagccaccaggaagtacaggagcagagtaaacaacagttgaggtcaaaagggtccaatttccttggacaagcaggcctcaagaaggcctctgagctgcactgccaactgtattgtattcttgtgtgtgttctgtgtgaacctaacacccccggcggccaagggaagccccttggccctcccttgggtggcagccaacactaggaccagagaagtggcagttgtgtcataaagttcccaagacacttctggaggaatcaatcttcttttttagtcttctctgctcattttttcttgtcattttcctgtatgtatatcttttccctctctcttctagcccagaaatgcttattgaccactggtggcctattgggagtggattacttgacacattcacatttactctgtgcccagatgctaggcacagaagtaggtgctatgggcacaggcattcgacaagaatttattgagcccatactatgtgccagacatggctctagaccctaaggatatagaaatgaataag

SEQ ID NO: 1972 - DNA, 700 bp, Homo sapiens
ctctcttctagcccagaaatgcttattgaccactggtggcctattgggagtggattacttgacacattcacatttactctgtgcccagatgctaggcacagaagtaggtgctatgggcacaggcattcgacaagaatttattgagcccatactatgtgccagacatggctctagaccctaaggatatagaaatgaataaggcaacacccctgctcttatgaaactcatataccggtggaggcagacaacacacaaataaacaaggaaagtgtcacatcgtgataattattctgagaaataaaatagcatgatatcatacagagtacagaggtggtcacattagatttggcactctaggactgtctatctgaggaggtgacattttagttctctaagtgacagaaggggtgacaatgtgcagaacaaggggaagtgcattccaggcagagggaatagctagtgccaaggccttgggaaaagaacaagctcagtctgtttgcaggaaaagattggtgtggctgcagcatggtgggcaaggaggtgaatgatagacgatgaatgatagaacatgcagctcataaggtaggaaggggtcagataaggtgggcatttggggcctctgatcaggggcttgggccttatgcacagggtgaaatgggccagtgtgcattttacttatttttaaacttttaagttttct

SEQ ID NO: 1973 - DNA, 700 bp, Homo sapiens
aggaaaagattggtgtggctgcagcatggtgggcaaggaggtgaatgatagacgatgaatgatagaacatgcagctcataaggtaggaaggggtcagataaggtgggcatttggggcctctgatcaggggcttgggccttatgcacagggtgaaatgggccagtgtgcattttacttatttttaaacttttaagttttctgtttttcatttttttagatggaaaaatgttgtccaggctggtctcgaactcttgagctcaagcatttatcctgcctcagcctcctgagtagttgggattacaggtgctcatcactgtgcctggctcagtgtgcattttagaaagctcactggctgctgtttgcagactgggctgcagtggggcaagtgtggaaataaggagaccactggggagactggagtaggagggatgaactagagtggtggtggtggcaatgatgagaatggggaatgaacccaggcagagtatagaggggaggacacacagagatgaataaaatgtggtggctccgaatgggagaaaatatttgcaaaacatatatctagtaaagggtatgtatctagcatatgtaaagaatgcttacaactcaataaggcaatgcatttttgtttgtttgtttgtttgtttgttttttgagacagagtctcactctgtagcccaaactggagtgcagtggcacg

SEQ ID NO: 1974 - DNA, 700 bp, Homo sapiens
acacagagatgaataaaatgtggtggctccgaatgggagaaaatatttgcaaaacatatatctagtaaagggtatgtatctagcatatgtaaagaatgcttacaactcaataaggcaatgcatttttgtttgtttgtttgtttgtttgttttttgagacagagtctcactctgtagcccaaactggagtgcagtggcacgatctcagctcactgcaaccttcgcctcaggggctcaagcgattcttgcgcctcagcctcctgagtagctgagactacatgcgtgtcaccacgctcagctaattttttgtcttttaagcagagatgggttttcaccatgttgcccaagatggtctcaaactcctgaactcaggtgatctacccacctcagcctcccaaagtgctgggattacaggcatgagccactgcacccatcttgacaaccaaattttttaatggacagaagatttgaacgaatttttcgccaaaaaaggatacgcaaatagtaaatacacatatgtaaagatgctcaacatcattagtcattagggacatgcaagttaaaaccacgatgaaatgccactacacatctacctggatggctaaaatgaaaaagactaactgtgccaagtgttggcaatgacgtggaacaactgggatgctcctaaactgctggtgggaatgtaaaatattcattttttc

SEQ ID NO: 1975 - DNA, 700 bp, Homo sapiens
atagtaaatacacatatgtaaagatgctcaacatcattagtcattagggacatgcaagttaaaaccacgatgaaatgccactacacatctacctggatggctaaaatgaaaaagactaactgtgccaagtgttggcaatgacgtggaacaactgggatgctcctaaactgctggtgggaatgtaaaatattcattttttcttgactttttaatagagatagggtctcagtatgttccccaggctggtcttgaactcctgagctcaagtaatcctcccactttggcctccaaagatgctgggataacaggcgtgagccaccatgcccagctgggaaggtaaaataatacaactacagtcacgtgctgcataatgatttttggtcaaggacagactgcatatacgacaatgatctcatgagattacaatactgtatctttactgtgccttttctgtgtttagatatgcttagatacacaaatatttacccttgtgtggcagtcgcctacagtgctcagcagagttacttgctgtacaggcttgtaccctaggagcaataggctataccacatagcctaggtgtttggtaggttataccatctaggtttgtgtaagtacactctatgatattcacacaaggacaaaattacctaatgaagcacttctcagactgtatccttgttactaagcaatacatgatta

SEQ ID NO: 1976 - DNA, 700 bp, Homo sapiens
cgcctacagtgctcagcagagttacttgctgtacaggcttgtaccctaggagcaataggctataccacatagcctaggtgtttggtaggttataccatctaggtttgtgtaagtacactctatgatattcacacaaggacaaaattacctaatgaagcacttctcagactgtatccttgttactaagcaatacatgattacattggaaagcaatttggcagttttttaaatagctaaatatatgcctatcatacagcctagccattcaattccaggtatttatccacaataaaggaaagtgtgtgctcacacaaagatttggatatgaatgcttacagcagcttaatttgtaatagccaaaacctggaaacaacaaaaatgaccatccacaagacagtggataaatagcttatggtatctacgcagtggattaccaccaggttccaggtttaggtaagataaagtaaacatactccaccctgtctcttccactaagtgaagcaatagaacctgtacagaatgtatgaaggactctgaagagtaaatagcagcagatgaattaggaaagaaaaatcagaatttggagtaccacggaattggaggagtttcccatttttccctctagtactccctgggctagactcgaaacagcctgaaacctggaagtgagcagcaggcacagacagtgggaatcccagag

SEQ ID NO: 1977 - DNA, 700 bp, Homo sapiens
gcaatagaacctgtacagaatgtatgaaggactctgaagagtaaatagcagcagatgaattaggaaagaaaaatcagaatttggagtaccacggaattggaggagtttcccatttttccctctagtactccctgggctagactcgaaacagcctgaaacctggaagtgagcagcaggcacagacagtgggaatcccagagccctctagttctgctttgaggagtggggagggaactcctaatgctcagaaagagtgagaaaataaccacccccacgccacctttttttcttttctccattctctcatgcctcagacctctggcattcttgttgcaatggcatgagaggactaaaggcacctaaaattctaagggagagaaaactgtctgttggacaagccccaagagggtctccctccttccccccttctctctctctctctctctctctctctctctctcaatatctctctccttttgccagttgaccctagctgagggcacagtcgcaggaagtacacagcagagcaaggtagctaaaactccagatttctggccagaggaccaaaaggaggagacccagggaatcagaaagtaccagggagatcatggaaagggaggaatgctggaaactgaacccacaaagttgtttatgaattcctgggctcaactccaaactgagcttgcatggatctagcata

SEQ ID NO: 1978 - DNA, 700 bp, Homo sapiens
cacagtcgcaggaagtacacagcagagcaaggtagctaaaactccagatttctggccagaggaccaaaaggaggagacccagggaatcagaaagtaccagggagatcatggaaagggaggaatgctggaaactgaacccacaaagttgtttatgaattcctgggctcaactccaaactgagcttgcatggatctagcataccaaagacttgagaactgaacctaaggataaacaccacccttttctcaagctgaccactggagggtgcacacacaggacagatctaaacagcactataaaggctttgaaaatggaacaaacattgaaactacaatccacagaaggctggtcggaacttgtggcccaaatgcagctgcattgattgcctgctaaaatataaacattaacactctccacaatgttcaaataatacccagagtctcataaaatttaaaatgtccaggatacaaaaccaaagtatgatcttcctggcctatgataggaaaaatctcattttgcatgggaaaagacaatcaaaagagaacaatgatgagatgttggaattaagtaacaaagactttaaagtactactatgaaaatgctccaagtaaaccctcttggaatgaatggaagatggacagtctcagcaaagaaataggagatataaagaatagggaagtaaaagttttggaacttaaaa

SEQ ID NO: 1979 - DNA, 700 bp, Homo sapiens
aggaaaaatctcattttgcatgggaaaagacaatcaaaagagaacaatgatgagatgttggaattaagtaacaaagactttaaagtactactatgaaaatgctccaagtaaaccctcttggaatgaatggaagatggacagtctcagcaaagaaataggagatataaagaatagggaagtaaaagttttggaacttaaaaatataagggccaggcatagtagttcatgctataatcccaacactttgagaggccaaggcaggaggataacttgagcccaagagttcgaagctagcctgggccacaaagtgagaccccgtctctaaaaaaaataataagttaggtgtgttggcatgaacctgtggtcctagctacttggaaggctgagatgggaggatagctcaaacctgggagttcgaggctgcagtgagtcgtgatcacaccactgcactacagcctgagtgacaaagcaagaccccgtctcaataaataaataaataaataaataaataaataaaatataagaaccaaaatttcagtgctcactaggtaactcaagagcagaatataaatgagaggaaagaggaagccagtaactggaagacagaccaacagaaattatccaaacagaaaaacagtgagaaaaagatttttaaaaagtgaatagaacctcagagactagtgagacaataccaaaggtc

SEQ ID NO: 1980 - DNA, 700 bp, Homo sapiens
ataaataaataaataaaatataagaaccaaaatttcagtgctcactaggtaactcaagagcagaatataaatgagaggaaagaggaagccagtaactggaagacagaccaacagaaattatccaaacagaaaaacagtgagaaaaagatttttaaaaagtgaatagaacctcagagactagtgagacaataccaaaggtctaatatttatgtcattagagttccagaaggaaagaagaaagagtgcagtgaagataaaaatgtttgaggaaatattgactaaaaacatcttcaatttggaaaaggacataaaactgaagaatatatgtacatatatatatatatatatatacacacatacatacatataagcatacatgtaccattgctagagaaaaatgacacatcacacataggagaacaattcaaatgacttcagcttcctcatgaggagagaggaaatctcatcgtagagaccagtaggaagtggaatcacatctttaaaatgaagaaaaagaaccatcaacccaccattctcttcacaatttcaagaatactcaatgaaaatatgcctcaggagtgagagtgaaataaagacgttttcagatgaaggaaaactaagagagttctttgacaacagacccgtcctaaaataattgctacaagaagtttttcagacagatgagaaatgataccagaag

SEQ ID NO: 1981 - DNA, 700 bp, Homo sapiens
taaaatgaagaaaaagaaccatcaacccaccattctcttcacaatttcaagaatactcaatgaaaatatgcctcaggagtgagagtgaaataaagacgttttcagatgaaggaaaactaagagagttctttgacaacagacccgtcctaaaataattgctacaagaagtttttcagacagatgagaaatgataccagaagttaacttggaatatcaggaatgaaaaaaagaccaacagaaatggtaaagatctgaggtaatgcaacattctgtgctgctcttgagttctttaaaatacgttttatggttaaaacaaaaattataacattttttgatggtgttttcaatgttatatgtagatagcacataagacaactacaacataaagagggtagaataaaagaaactaaagttttacattacacttaaaatggtaaaatattgattctaagtagaccatgaaaaggtaaagacgtatattgtaatccctggagcaaccactaaaaacaaaaacaaaaacaaacagaactatacaagcagataaagttaaaaacacaataaatgtccttaaaatggtagacacaaatccaaccatatcagtaattccattaaatgtaaatgatctaagaatggtatcagcaaaaatggaatagagaactccaaaactcctttttccataaaaaacagtgaaaaaaactgg

SEQ ID NO: 1982 - DNA, 700 bp, Homo sapiens
ctaaaaacaaaaacaaaaacaaacagaactatacaagcagataaagttaaaaacacaataaatgtccttaaaatggtagacacaaatccaaccatatcagtaattccattaaatgtaaatgatctaagaatggtatcagcaaaaatggaatagagaactccaaaactcctttttccataaaaaacagtgaaaaaaactggcaaaatcaactttattagaactctggagactaataaaaagtttaataaataaaataaattcttttttttaataaaataaattcttttttttttttttgagggagagtctcattctgttgctctggctggagtgcagtggtgtgatcttggctcactgcaacccccacctcctgggttcaagcgattctcctgcctcagcctcctgagtagctgggattacaggtgccctccaccatgcccagctaatttttgtattttcagtggaggcagggtttcaccatgttggccaggctggtcttgaactcttgacttcaaatgatccacccacctcagcctcccaaagtgttgggtttacaggcatgagccacaatgcccagccaataaattttaatcaagaagaaaaacggctaaatctcagtgggaaaacactgtggtgttttaacatacctgggctccattctcctctttcccagcttggtggcagccttgaagacaacagc

SEQ ID NO: 1983 - DNA, 700 bp, Homo sapiens
aactcttgacttcaaatgatccacccacctcagcctcccaaagtgttgggtttacaggcatgagccacaatgcccagccaataaattttaatcaagaagaaaaacggctaaatctcagtgggaaaacactgtggtgttttaacatacctgggctccattctcctctttcccagcttggtggcagccttgaagacaacagcctgcattcttgatataggttcttagtgttcgagggagcagaatggaacttactctcaaaggattgtggttgcctgttttgacctgtctgttggttccctgaaggatgagcacaaaagatttactttaatttcacctaacttagaactctcccagggctgaagcagctacctggggcatttggaaaaacaaacaaaccacacacacatgcacagagttaaaaacaaatgcattcactaatggtaacagttagggaaataatagacaaaccaaaagcttaagaaaaaaggctggagaaggaaacactttaagaaataagggctttaaaaagctttctggatatctaagaaggtcacacatatgctcagaaaatatcctagaagactctacactctcacctctgactgacctccagactctgcaagcagaaaaggaaggttaaggcagagttgtaaacagcctggctaagtgttaaaagccacacctcaaaacacatacagag

SEQ ID NO: 1984 - DNA, 700 bp, Homo sapiens
acactttaagaaataagggctttaaaaagctttctggatatctaagaaggtcacacatatgctcagaaaatatcctagaagactctacactctcacctctgactgacctccagactctgcaagcagaaaaggaaggttaaggcagagttgtaaacagcctggctaagtgttaaaagccacacctcaaaacacatacagagctcatctgaagatattgggaattttttttttatgttgttctaggtataaaggaaatttcagtcatcactagccaaccactagtggaaaagtttaatggaaaagtcttttcagtggccacacgtgacaaagaatacagactttaaaaaattagttcagaaaggtcactaagtaaacaacaacaacaacaacaacaaacaaaaacaactagcaaacaatgacaacaaacctgaaaggggagcagaatgtgatttccagagttgtcacattataacagtaaaaatgtccagttttcaacaaaaaaaattacatgccatgaaaagacagaaaaaagtatggttcatacgcagcaaaaataattaatagaaactgtccttgaggaagctcaggaattgaacttaatagattaagattttaaatcaagtatttttaaatgtactgaaagagctaaaagaaaccatatgcaaagaactaaaggaaagcatgaaaacagtgtctcgcc

SEQ ID NO: 1985 - DNA, 700 bp, Homo sapiens
aaaattacatgccatgaaaagacagaaaaaagtatggttcatacgcagcaaaaataattaatagaaactgtccttgaggaagctcaggaattgaacttaatagattaagattttaaatcaagtatttttaaatgtactgaaagagctaaaagaaaccatatgcaaagaactaaaggaaagcatgaaaacagtgtctcgcctaatagcagatttcagtaaaagaatagaaattataaaaaaggacttagaaattttgagttaagaagtaaaataagtgaaatgaacaatgcactagaaggggtcaacagctatgtgagtaggcaaagaatgaatcagtgaatttgaagacaggtcaattgagattacccagtctgagggacagaaaaaagaatgaagaaaaacaaatagagcgtaagtggcctgtggaataccactgatggtaccaacatatgcataccagaagacccagggggagaggaaagaaagaaaggggatgaaagaatatttgaagaaataatggctcaaaacttctcaaatttggtaaaagtaaaggatatgaatttacacatgcaagaagctcaacaaaccccaagtaggataaactcagatattcatattgtgatacattataatccaatggtcaagataaatacaaagagagaatcctgaaagcagtcagagagaagtgatgagtcatata

SEQ ID NO: 1986 - DNA, 700 bp, Homo sapiens
aatatttgaagaaataatggctcaaaacttctcaaatttggtaaaagtaaaggatatgaatttacacatgcaagaagctcaacaaaccccaagtaggataaactcagatattcatattgtgatacattataatccaatggtcaagataaatacaaagagagaatcctgaaagcagtcagagagaagtgatgagtcatatacaaggatacttaatgtgattaatggctaatttcccatcagaaaccacagaggccaaaaggcaatatgatgacatattcaaagagctgaaagaaaaactgtcaaccaagaattccatatgtggcaaaactattcttcaaacatgaaggagaagttaagacattcccagataaacaaaaactaacagagttctttgctagtatgcctgttgtacaaaagttgctaaagggagtccttcaggctgaaatgaaagaacacttgtgatgattaattttatgtgtcaacttgactgagccacagggtgcctggatgtttggtcaaacattattctggatgtttccgtgaggatgtttacaggtgaaaataacatttaaattggtacactgagtaaaggagattaccctccctaatatgggtgggcctcattcaatcagttaaaggcctaaatagaacaaaatgactgacccttccccaagtaaaagagagtttctcctgcctgcct

SEQ ID NO: 1987 - DNA, 700 bp, Homo sapiens
tgcctggatgtttggtcaaacattattctggatgtttccgtgaggatgtttacaggtgaaaataacatttaaattggtacactgagtaaaggagattaccctccctaatatgggtgggcctcattcaatcagttaaaggcctaaatagaacaaaatgactgacccttccccaagtaaaagagagtttctcctgcctgcctatctttgaactgggacattggctttttcttgccttcagactcaaactgaaacattggttctttctttgtctggagcctgctggccttcagactagaactaagtcattaactctcctgggtctccagcttgccaagtcaccgtggagattttggtacttgtcagtctctgtaatcatgagaattaattctttataatctcctctctctctctctacacacatacacacaaacatgtgtatatgtatatacatatataatatatatatatatatacagcttgctggttctgtttctctggagaaccctgactaatacaactaatacaacattatgcagtaacttaaatccacatgaaaaataaagaacaccagttatgataactatgtaggtaaatataaacattaatattaatgatatattttttgttttaaactctttattttctatatgatttaaaatacaatcataaaacaatgatcctaaaactatgttgatgggca

SEQ ID NO: 1988 - DNA, 700 bp, Homo sapiens
aaccctgactaatacaactaatacaacattatgcagtaacttaaatccacatgaaaaataaagaacaccagttatgataactatgtaggtaaatataaacattaatattaatgatatattttttgttttaaactctttattttctatatgatttaaaatacaatcataaaacaatgatcctaaaactatgttgatgggcataggttgcataaagatggtttggtgtttttgtttttgttttttgtttcttgggtttttgtttttgttttttttgtagacagagtctcactctgtcacccaggctggagtgtagtggcaccatcttgactcactgcaacctccacctcccaggttcaagcaattcttgtgcctcagcctcctgagtagctgggattacaggcacataccaccacgcccagctaattttttgtatttttagtagacatggggtttcatcatgttggccaggctggtcttgaactcctggcctcaagtgatctgcctgcctcagcctcctaaagtgctgggattaaaggcatgagctaccaccccggccacattacataaagatgtaatctgtgacattaacaacaaaagttagagatgaaattatacagcagtaacttttttgtataccattgaaactaagttgttattaatttaaattagagtgttgtaaattaagatgttaattgtaatc

SEQ ID NO: 1989 - DNA, 700 bp, Homo sapiens
gcctgcctcagcctcctaaagtgctgggattaaaggcatgagctaccaccccggccacattacataaagatgtaatctgtgacattaacaacaaaagttagagatgaaattatacagcagtaacttttttgtataccattgaaactaagttgttattaatttaaattagagtgttgtaaattaagatgttaattgtaatccccaggacaaatgctaagaatataatatgtagtaaaataaatgagaaaggaatcaaaagagtatactacaaaaatctatcttacacaaaagaagacaataatggaggaactgaggaacataaaggataaaagacataatagaggacaaatagcaaaatgacagaattaagttctctcttatcagtaattatattaaatgtaaatgaattaagctcttcaatgaaaaggcagagattggcagaatggattttaaaaagaaccatgatccaactatatgctgtctataagagacttattttagattcaaagacacaaataatttccaagtgtaaagatggaaagcataccatgcaaacagtaaccaaaaatgagctgaagtggctatgctaatatcagacaaaatggacattgacacaaaaatgtttcaaaaaacaaagaagtacattaatatgataaaatgctcaatgtattaagaagatattgcaattataaacaaatag

SEQ ID NO: 1990 - DNA, 700 bp, Homo sapiens
gattcaaagacacaaataatttccaagtgtaaagatggaaagcataccatgcaaacagtaaccaaaaatgagctgaagtggctatgctaatatcagacaaaatggacattgacacaaaaatgtttcaaaaaacaaagaagtacattaatatgataaaatgctcaatgtattaagaagatattgcaattataaacaaataggcacttaacaacagagaccaagaacctatgacaaaagattgacagaattgaatgaaaagttaaaaaatagtcggaggcaaggtgcagtggctcatgcctataatcccagcacaatgggaggctgaggcaggcagatcacttgaagtcaggagttcgagacctgctgggccaacatggcaaaaccccgtctctactaaaaatacaaaaattagccaggcatggtgaagcacacctgtaattccagctactcaggaagctgaggcacgagaatcacttgaacccaggaggcagaggttgcagtgagccaaggtcatgtcattgcactccagcctacatgatggaatgagattctatctcaaaaaaaaaaaaaaagttggagacttaatactcatgttcaatcgtagctagaacaactagacaaaaggtaaacaaagaaatagaagacttgaacaacaataaaagccaccaaacctaacagacatctacagaacatttcattc

SEQ ID NO: 1991 - DNA, 579 bp, Homo sapiens
tgagccaaggtcatgtcattgcactccagcctacatgatggaatgagattctatctcaaaaaaaaaaaaaaagttggagacttaatactcatgttcaatcgtagctagaacaactagacaaaaggtaaacaaagaaatagaagacttgaacaacaataaaagccaccaaacctaacagacatctacagaacatttcattcaatgacagcagaatacatattattcttctctgcacatggaaatattctatagaagagacattgtgttaggccacaaaacaagtctcaataaattagacaagattgaaatcaaacagggccaggtgtggtgcctcacacctggaatcccagcactttgggaggccgagacaggcagatcacccgaggtcaggagttcgagaccagcctgaccaacatggtgaaaccccacctctactaaaaatacaaaattagctgggcgtagtggtgcatgcctgtaatcccagctactcgaggggctgaggcaggagaattgcttgaactcaggaggtggaggttgcagtgagccgagatcacaccattgcacttcagcctgggcaac

SEQ ID NO: 1992 - DNA, 700 bp, Homo sapiens
  misc_feature (1)...(700): n = A,T,C or G
ttgtggcaaccccaggaaatgaatagatcaggagcccagatggagtctgagggccttatgttaagggctgagtggtgaaagtgaggctacaaaggcagaggtcagaaatggtatcttctgggtggaggcaggtagaggaaaaggaatataaaaacaaatgaatggccacttcctgcaaggcaggaagaccaaggagacatgatcctcagaagtcctgccccttctcaaggctgcagattttttaggaggatatctgaccaatgctgtggtcctgagctgccaggactccaagaccctgcggaggtcttactcatgcctttggagactaaatcttacagtgtggagcaaggtattgaggagatatccgtccattcaaggagttagcaaatatnngcccagttcggtggtgggaaaatggcaatggacaaatgcatgcatggtttatgtactcccagncctcccaggccagtcggggaagacgttacccaagcgatcattcaattctatcaacggtggcaagtgttacgaagcacacggggacatgagaagctgttatgggaggttttgtgtgtgtggtttttttttttttttttttgagacagtcttgctcttgtcacccaggctggagtgcaatggcacgatcttggcttacggcaacctctgcctcctgggttcaagtgattctcccacctcagcctcc

SEQ ID NO: 1993 - DNA, 700 bp, Homo sapiens
attctatcaacggtggcaagtgttacgaagcacacggggacatgagaagctgttatgggaggttttgtgtgtgtggtttttttttttttttttttgagacagtcttgctcttgtcacccaggctggagtgcaatggcacgatcttggcttacggcaacctctgcctcctgggttcaagtgattctcccacctcagcctccctagtagctgggattacagacaccgccatcatgcgtggctcactgcaagctctgcctcccgggttcatgcgattctcctgcctcagcctcctgaatagctgggactacaggcatgcgccatcacacccggctaattttttgtatttttagtagagacggggtttcatcatgttagccaggatggtcttgatctcctgaactcgtgatccacccgcctcggcctcccaaaatgctgggattacaggcgtgagccaccgtgcctggccatgcccagctaatttttgtattgttgtagagacggggtttcaccatgtcggccatgctggtctcgaactcctgacctcaggtgatccgtccgcctcagccttccaaagtgctgggattacaggcatgagccaccgtgcctggtctgttatgggaggttttgacctactcagggaagtaaggaaaatctctctgcctctgagggaatctgaaggattctgaaggttttaatcagg

SEQ ID NO: 1994 - DNA, 700 bp, Homo sapiens
  misc_feature (1)...(700): n = A,T,C or G
gggtttcaccatgtcggccatgctggtctcgaactcctgacctcaggtgatccgtccgcctcagccttccaaagtgctgggattacaggcatgagccaccgtgcctggtctgttatgggaggttttgacctactcagggaagtaaggaaaatctctctgcctctgagggaatctgaaggattctgaaggttttaatcaggggggaaaaattttttctagacagaaggaacagcatgtataaaggtctggggtggggagggggaatgnccagttagagagactggaggaagttcgatgtggttacagaagtgagcagaggccaaaccatgtggaaccttataaaccactttttgatgtttctcangatcaggncaatttcccagntgcaagtaatggnctcagatctgcattttgagatcatcatggttgtantgaaggagagatgagagggaacnnnaatggaggagcagccagtcaggaaagtgttgccatcactcatgtgaaaaagatggagagaagtgggtggattagagggagatttaggggtaaaattgaacagacttgggatataggtaaatagggtctggggatgagggagagggagctgccaagtatgactcccaggcttctggttaggtaactgatgggaagtatctccttcagtacagcagtgaagacaggatgtgtggagggggaagat

SEQ ID NO: 1995 - DNA, 700 bp, Homo sapiens
tgaaaaagatggagagaagtgggtggattagagggagatttaggggtaaaattgaacagacttgggatataggtaaatagggtctggggatgagggagagggagctgccaagtatgactcccaggcttctggttaggtaactgatgggaagtatctccttcagtacagcagtgaagacaggatgtgtggagggggaagatgtagggggagaacaataactctgtgttggacatgttgccattgaggtgcctgtggacactcaagtggggatgtacactgaacagtgagttacatgaatctggggttcagcagtaaggataagggtaaagagagaaatttgtgtcacctgcgtgtaaagagaagcgtgaagtggaaagcctagacctgagttttgaggaacccccaacctttactaatagggagaggatgctgaagaagcttgagcagaggtggccagaaaggatgaggggaaaccaagggaaatcagtgttccagaggggctgtggtcatcgctgggtgtcagacactgctcagggccctggcagatgaggtctgaagaacagccgttgaaattggagattggaggctacagtttattgagacctggtttggtgctgttagggagctagaaggctgactgcagggcctgaagagtgggagagacagctcctttagggcctgaagagtgggagagatgtga

SEQ ID NO: 1996 - DNA, 700 bp, Homo sapiens
  misc_feature (1)...(700): n = A,T,C or G
ctgtggtcatcgctgggtgtcagacactgctcagggccctggcagatgaggtctgaagaacagccgttgaaattggagattggaggctacagtttattgagacctggtttggtgctgttagggagctagaaggctgactgcagggcctgaagagtgggagagacagctcctttagggcctgaagagtgggagagatgtgaggatggggagacagctctttcaagaaattccgctgcggttgagaacagagacactcagtggggtcgaatgagggttttgttcccatagtagaggcttgaacacatttacaggccaatgggaaagatccagttgagagcgggtagttgagccttcaggagagaaaagggatgttccatggggcaaactcctgagaagggggaggagatggaaggaagcttctgtggatgtagcagatgcaggagggtttgtgtagttttagccgggctcgagccggtggctgacgcaggcaggaacaatggctcacccatgttttatgtgtatttccgtgtgcgtgctcctgctttccccaggtctgggccgcctgcctggcccgtgtgccgtagggaatatccacactgggcctgggcggaggctgggcatctcccgctctgggcttgctccctgatgagattctcagaccgtgcttcccctcattcatgagangaaggttcacagagca

SEQ ID NO: 1997 - DNA, 700 bp, Homo sapiens
  misc_feature (1)...(700): n = A,T,C or G
ctcacccatgttttatgtgtatttccgtgtgcgtgctcctgctttccccaggtctgggccgcctgcctggcccgtgtgccgtagggaatatccacactgggcctgggcggaggctgggcatctcccgctctgggcttgctccctgatgagattctcagaccgtgcttcccctcattcatgagangaaggttcacagagcaggcgtgggaacctgcctggccgccagggcctcctcccgctcaggctgaggtttgctgcatctctgtccttattcccttccagactggattggctgaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatg

SEQ ID NO: 1998 - DNA, 700 bp, Homo sapiens
ctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgcaggcagggaaatccgtcagcctccagggacgctctccctacagccccggcgaggggatcgggtcgtggcgacctctccagacgcccaggggctgggcaggagggcgggccaaggcccgcaggtgggggcgccaaagccaggcgggcgcggagtacgtgcggtgggctgcgggcggcatgaagggcgcgggcggccagctccggctccggctccggctccggctcccgcgaggccgggtagcctgggcgttcccaggggtcgcagaggatggcgaaccccggcggagccaccggagctggggaccaggacgcaggcaggcgtgtggagcgtgaggtggggacgtggcggcggctcaagtgggcggagccccggcagcggccggaggcggagtcgccaagggaggaggcgccgagctgaccgggcgacgccgcgggaggttctggaaacgccgggagctgcgagtgtccaggtgagcgccccgcccgctca

SEQ ID NO: 1999 - DNA, 700 bp, Homo sapiens
ccggagctggggaccaggacgcaggcaggcgtgtggagcgtgaggtggggacgtggcggcggctcaagtgggcggagccccggcagcggccggaggcggagtcgccaagggaggaggcgccgagctgaccgggcgacgccgcgggaggttctggaaacgccgggagctgcgagtgtccaggtgagcgccccgcccgctcagccgccagatcaaccttagcgctggggcgcgggctggggtcgccaggcggtgcgttctgcccgcgcggggctgagagttaggggccggggccggatccggggccgggggtcgcgccgctagccgccagcagcgcagtccgggccgccaccctgcaccctccgccctgtttctgcacccgtctgggttcttgtgccgccgcccgcaagccttcccgagctcagggtggtgaggtcagcggcgcccttcgtgcagttccctcggctgtcgggcggggctgggaacttggccgctcttccctgtcaggctcccgggaagtggcggcctgaccccgggctgccggctgttgggagcgggggcgcggcgtccgcctggccctgaggggcctcttcatattggctaagcccgttctgcaccctcccaagggctgggagtcctaggtcttgtccgggcagggtccagcttggagcccattagatgggccattggatcagaaagtctt

SEQ ID NO: 2000 - DNA, 700 bp, Homo sapiens
  misc_feature (1)...(700): n = A,T,C or G
tcaggctcccgggaagtggcggcctgaccccgggctgccggctgttgggagcgggggcgcggcgtccgcctggccctgaggggcctcttcatattggctaagcccgttctgcaccctcccaagggctgggagtcctaggtcttgtccgggcagggtccagcttggagcccattagatgggccattggatcagaaagtcttttctcccccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtggnagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaag

SEQ ID NO: 2001 - DNA, 700 bp, Homo sapiens
  misc_feature (1)...(700): n = A,T,C or G
gctggcaaaagggcatcgtggacagaggaacagcctatgtgagtggnagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccaggtgggtccctggcctttgtattctatttgactttaagatggtgcaggagaatacaaaaaactatccgggcatggtggcgcgcgcctgtagtcccagctactcgggaggctaaggcaggagaatcgcttgaacctgggaggcagaggttgcagtgagccaagatcgtgccactgcactccagcctgggagacagagcgagactccatcttaaaaaaaaaataaaaaagagagatggtgcaggagagcattgggatccctcccaagactgtgactgttgtcttttgctgtagagtgacacccgagatttgtgcttcttgataatagactacctggggcctcacagccccagccctcttgtaggaaatcctgtcctaagancaagggctggagtccgttacgttgtagcttggggcattcttaaatgtcc

SEQ ID NO: 2002 - DNA, 700 bp, Homo sapiens
  misc_feature (1)...(700): n = A,T,C or G
agagatggtgcaggagagcattgggatccctcccaagactgtgactgttgtcttttgctgtagagtgacacccgagatttgtgcttcttgataatagactacctggggcctcacagccccagccctcttgtaggaaatcctgtcctaagancaagggctggagtccgttacgttgtagcttggggcattcttaaatgtcccagactttgtggagatccattgtccacctaagaatttataggatgtttttggggtctgctgcttgttctcagcctgtgtctcatctgacattaggttccataatttagtctctgttaaatgaactaggatttcctttggcttgtacttaaactgcccctgaggtgtccaaggtgcagcctctcactgtggttctgggcctcagcgcccagtctctctggttgcttctccccactcacagaatgtttggtctttgaattcttttcttttagggcctccttgttcttacacagccgagtgtccactgtgtggcccagccaatgaagccacgtagcaaggatggagtgagttggctgggggcctcatcccaaagatgctgtcatactggatcaccctagttctctgagagctcagcaggcagacttggtgacagcttagctgaggcattgtctgtggcatgtgataggcccttgtatcctgtcgaaagctctgcattggggta

SEQ ID NO: 2003 - DNA, 700 bp, Homo sapiens
  misc_feature (1)...(700): n = A,T,C or G
cactgtgtggcccagccaatgaagccacgtagcaaggatggagtgagttggctgggggcctcatcccaaagatgctgtcatactggatcaccctagttctctgagagctcagcaggcagacttggtgacagcttagctgaggcattgtctgtggcatgtgataggcccttgtatcctgtcgaaagctctgcattggggtactctagacagtgcttacttagtcaccggtttagactggccccagctgatctcagttcatcccttgagtgccttctgcctgtttggcttctgactggagcgtgcctggggctagaatgagggacgagagagaggaggtggcngaggcactattcttgcctgtgggtagctcgtactctgagattgctgcttcatattggcagctggccatgtgccaggggaggagcccggctgtgagtgctcatcaaaggaagagactacgtgggtgcagctctgaggaatgagtcggttgagggaatctagggtctcctcatttcctaagaaggcctccctttttcactctgccctcccacatccttgggagggtctgagactggaagcaaggccttggctgatgtgtggccacgctggctgatagtgtgcagagggctaggaggtgtgtccctggctcctggggtctgtcaagagtttactattatgcagatggaagttggcaggaaaa

SEQ ID NO: 2004 - DNA, 700 bp, Homo sapiens
  misc_feature (1)...(700): n = A,T,C or G
gggtctcctcatttcctaagaaggcctccctttttcactctgccctcccacatccttgggagggtctgagactggaagcaaggccttggctgatgtgtggccacgctggctgatagtgtgcagagggctaggaggtgtgtccctggctcctggggtctgtcaagagtttactattatgcagatggaagttggcaggaaaagctgtgatgcaagtacatgcaagcccagcagagtgctggagtgagagttaaacttcgggaaagttgctcacatctagcaatttggacatttgaagttccttagggtaagacatcagcctgtcctagagcaaagagggctggaaggtcctgtggtctgtgggctttgtgttacggacatggaatgagagatagaaagacagtttttttttttttttttttttcctcanagcagagganaatgaaaagtctggatgatttactggagccctanaananagttcttgttcagctggtgtcattgcagggcanaggattaagtgtttgggtagagtgctctccagctcagatggaatctatctgagcctggtaacaggccagcatctgctctggacctttcaggaagtgcttgcttagagtgtggcctgttttgtacctggcactctgagggccagggtgtagtggagatcctcaggcctgggtacttgtaggagcctggaatg

SEQ ID NO: 2005 - DNA, 700 bp, Homo sapiens
  misc_feature (1)...(700): n = A,T,C or G
gcagggcanaggattaagtgtttgggtagagtgctctccagctcagatggaatctatctgagcctggtaacaggccagcatctgctctggacctttcaggaagtgcttgcttagagtgtggcctgttttgtacctggcactctgagggccagggtgtagtggagatcctcaggcctgggtacttgtaggagcctggaatgagcaggtcagaggcatataagtacatgagttcctagagtattggtccaatccccccgccttttgctagagaacattgcttgatgagctttagagccagtgattgaccagttccagggttatcccctgatgatcaatgtactacattatacctgattccagtctctcctgaattaaatgtttcatttcttgtggtgctcctggaacatggagatcgcccaatttctgccttgtttgcatcttcactgttccctagtctggaccttctttctcacccaggaatcagctgacttgggctgggcagctggctgcctcaggtccactgatgtttctctggtgcccttggtactaatgattgacataaattatgcctagtgcagggctacctgccaacatctgtcatcacattcagtcctccaacagccctatgagatataggtcctagtattgtctctattatatacatggggaaactgaggaatcctataacttgtccaaggtc

SEQ ID NO: 2006 - DNA, 700 bp, Homo sapiens
agctggctgcctcaggtccactgatgtttctctggtgcccttggtactaatgattgacataaattatgcctagtgcagggctacctgccaacatctgtcatcacattcagtcctccaacagccctatgagatataggtcctagtattgtctctattatatacatggggaaactgaggaatcctataacttgtccaaggtcacaaagccgggaagtggtatagaattggggtttaactcttagtatgtctgaccctagggcaggtgtgcctgtccatttgactgtactgccttgccctgagctggactggctggttatttgtgagtgctgtcatgtctaaggtaggagtgactgcccatctgaacttaagggaccatgttgctgttttctgggtccatgttgcgttcctccctctggtgagatccagccaggcgtgtcatggacctgctttatgaacctttggtgtaacccatgataaagtccttaacctgggcaggcatgttcttcctgggcaaagtgtggcttccctgtttgggagtccattgcactttaaggtaacagattattgagtaggactggatagctgcaatatctagcagagtgtgttttgggtttgactcttggttctgtcattgatttgctgtcagatgtcagatatgtaggaaaccttctctcagcctcagctgtttgtcatttgtatc

SEQ ID NO: 2007 - DNA, 700 bp, Homo sapiens
ttcttcctgggcaaagtgtggcttccctgtttgggagtccattgcactttaaggtaacagattattgagtaggactggatagctgcaatatctagcagagtgtgttttgggtttgactcttggttctgtcattgatttgctgtcagatgtcagatatgtaggaaaccttctctcagcctcagctgtttgtcatttgtatctatcttatatctgaaatggaggtagttatctagcttagaaggtttgggtgagaattagatagtagaaatgaaagatttttggaaacaaatagtgcttatctcagactatgttcccaggaaacagcctgagacagagcttaagtacttaatgctttattggaaggtgtaattgcagggcagccagggtgagggaaaacaaaagtgaggtgcaggcctgtgcgatggctcatgcctataatcccagcactttgggaggtcgagatggatggattgcctgaggtcaggagtttaagaccagctggccaatatggtgaaaccccatctctactaaaaatacaaaaattagctgggcatggtggcacacacctgtagtccaagctactcaggaggctgaggcaggagaatcccttgaacctgggaagtggaggttgcattgagccaatattgtgccactgcactccagcctgggcgacagagcgagactgtctcaaaaaaacaaa

SEQ ID NO: 2008 - DNA, 700 bp, Homo sapiens
ggccaatatggtgaaaccccatctctactaaaaatacaaaaattagctgggcatggtggcacacacctgtagtccaagctactcaggaggctgaggcaggagaatcccttgaacctgggaagtggaggttgcattgagccaatattgtgccactgcactccagcctgggcgacagagcgagactgtctcaaaaaaacaaaagaaaaaagtgaggtataaaggaggatgggaggtggtgttttagcaagctggctactctgcacagagatgtacttggttaccctatgagggccctttggtagccactggggaggccagtctggtacttcaacagagtctggagatagtgagaggagccagagattctggcgtgggcctggatagtctcctccactgggctgaggcaaagtaaataccctgggacctgggagatgggtgagaccaagaggttgcaaggtgggacgtaagatgcatccaatatagtggtatatggattttatcctcaagtgtagttcccttttgtgggttagtctcatccagactgccaagtctctgccaagactatgactgaaaacccaacttggcttttgcatgtcagttttaacagccttctctgctacttcattgtctagttactgaagcaagactttgtggtggtgatggtacccaggtggggaagtggaagtcaaccactattcat

SEQ ID NO: 2009 - DNA, 700 bp, Homo sapiens
cctcaagtgtagttcccttttgtgggttagtctcatccagactgccaagtctctgccaagactatgactgaaaacccaacttggcttttgcatgtcagttttaacagccttctctgctacttcattgtctagttactgaagcaagactttgtggtggtgatggtacccaggtggggaagtggaagtcaaccactattcatgtaccagactgagaaagtatgtggatagatacagataaacatcttggctttattaggttcttcgtgaaggagaatattttttcacataaagtagttgttgaagatacgaaacctggcatggtgagatgaggctagagagggcagtagggcctggtcacacactcaaaaggaccctttgggctaaagagtttgaactttatcttgacggcagtagagagccaaaggagggctttgataaaccatgctggctactttgtagagcagaggtgggaggaaggccagatgacatgtggagaggccagtgtagtgggggccaggatgcctgtaggggaagttaggggtggctcagatcagggtgatgactgaggctaaggagagtagggtaccccccatacttgcctagggtgccgtggcagcagcttataggcctgaatggacatccatgtgctttggtggcagggtctcctggagcctctggatcctcttaggctgaacacaca

SEQ ID NO: 2010 - DNA, 700 bp, Homo sapiens
agtgtagtgggggccaggatgcctgtaggggaagttaggggtggctcagatcagggtgatgactgaggctaaggagagtagggtaccccccatacttgcctagggtgccgtggcagcagcttataggcctgaatggacatccatgtgctttggtggcagggtctcctggagcctctggatcctcttaggctgaacacacaggtcctttcagccctgttatcctagagttggaggcagcggggagccgtgtccagttaggttttcccccttcacagaaggcaggcaggttcttgttcagtgccaagcaagaccagtttgttctcagcaagctcatgttctgtctctaggctgttaaatacattgttaaaactcaggctgttgcatttgggttgcagctgggagcttggcagagattctgcctgatgaggtaaggagagaagctaaggacgctgctggtttgcagctggaaacatcttttcatggccatttggccagattgtaaatgtcttttccaaagttcaggtttggtgggacctctggttgtatgtcttggaattgccctgtgtttagaaacagtgccagtcgcctgatgggtgaatcactgttgctgggatgttggcaggttttgcaggactttcctgtgggggtccaaacactagggctggcagggcccgtttggagtctgtttgagaagggcctg

SEQ ID NO: 2011 - DNA, 700 bp, Homo sapiens
aaatgtcttttccaaagttcaggtttggtgggacctctggttgtatgtcttggaattgccctgtgtttagaaacagtgccagtcgcctgatgggtgaatcactgttgctgggatgttggcaggttttgcaggactttcctgtgggggtccaaacactagggctggcagggcccgtttggagtctgtttgagaagggcctgctttgttttctttacattttaagcatatgataaaataattttaaaaattgctatagaatttcttgtagaaagattagagaaacaagcataaaaataaaaagaaattatttcaccaagatatagccagatgtatgactcttttcttgcatctctctatatacacatatacattaatttttccttacaaaaatggaattatagagtgcatattattggggcccacttttctcacttaacagtatgcttagatctcttcatgttgatatatagtattcatttttaatatactccataaaaactcattgtatagaagaaatgtaaaatcttctattgttgtagtttcctaatttgaacaagtctgtggtgaagtattttttgttgtgttcctggtatgggacagacattgttctaaactctggggatgcagcacagataaaactcagtattggttttctgctcaagatgtcactttgtttttcataaaagtgggtttgacattg

SEQ ID NO: 2012 - DNA, 700 bp, Homo sapiens
cattgtatagaagaaatgtaaaatcttctattgttgtagtttcctaatttgaacaagtctgtggtgaagtattttttgttgtgttcctggtatgggacagacattgttctaaactctggggatgcagcacagataaaactcagtattggttttctgctcaagatgtcactttgtttttcataaaagtgggtttgacattgttcacctccagacttattccagttggattctgagggtttctgggagggcttttagcagcactggacactttgtaggggcactcagcaggtacacatactttcacctactctgtcttaagcaagctgtgggcatagttatgagatgggttggaggttggcctttcccacattgtggggcacagtccctctcggatgctgcctcctcccaatctgactctaattagaggactttttgtacagagccttttgagttaaggggcccaggcttgggagaaatggggtagggctccagagtacccctgccagagatgtcagtgttgatgtggtagtctgggagctgctgcttggaggtgcccagctctccaggctagcagagttagttatccccttctcccaccagagcaagactttgcaggctcttggtaggtaagtcatctgtaattacctgtgattctttgaggctctgcccaaaccccatctgtgattctttgaggctctgc

SEQ ID NO: 2013 - DNA, 700 bp, Homo sapiens
tgccagagatgtcagtgttgatgtggtagtctgggagctgctgcttggaggtgcccagctctccaggctagcagagttagttatccccttctcccaccagagcaagactttgcaggctcttggtaggtaagtcatctgtaattacctgtgattctttgaggctctgcccaaaccccatctgtgattctttgaggctctgcccaaaccctatctgtgattctttgaggctctgcctccaggctgagattcaagaatgggctcagtctaagccagatcgcacattccagagaaatcacagctggtattcatgtaatgaagaaacctggctttccctgagtgttgtgaggtatgaaccgtagatgataggagcagaatgatttgaaaggaatggacagacttcctccctggaatttatctggcctctaaaaaggtatgcaactgcaactggagacacacctgggtagagatgctgggttccccacttccaaccatgtctggtttggaacctgcctgggccctgttctcccaccaccccagctctgaggagcagtcagctggtccctttctgatcacagatacatcctcccagctctatgttttcactgtcccctccctacatacatacagaaggtgctgagcctgagccagtcaagccttttgaggaacaagaaacagacacccaatcccttaggtataaggg

SEQ ID NO: 2014 - DNA, 700 bp, Homo sapiens
  misc_feature (1)...(700): n = A,T,C or G
tggaacctgcctgggccctgttctcccaccaccccagctctgaggagcagtcagctggtccctttctgatcacagatacatcctcccagctctatgttttcactgtcccctccctacatacatacagaaggtgctgagcctgagccagtcaagccttttgaggaacaagaaacagacacccaatcccttaggtataaggggcttgtgtaagcaagagagaagccttctgaaatcctgggatagagaagacagtatagtaaggccttggagcagacctgtggctagaaccaggagggcctggactctgcctcagggcaagcccaggcttactcactttctcttgatgacttgntctcttctgctgctctaactccctaatggaccccttagcacaatacgccctaccctgcagcaggttccaggttggaagataattgtcctgtgtgtcttgggacccccacacctagactatgacaggaagactgtcagctctgcagacatttggcataggcatgaacacatggcgccattcacttatgctttccttctgatagaggatccatttgcagatgggagttgtggttggccttctctgagcctaacctggaatctcaatggattaggatttcttctgaaagagtaagatgaggaatggtgggtgtgctgtgtgtctaatcaagtatggcgggcaaaaaactga

SEQ ID NO: 2015 - DNA, 700 bp, Homo sapiens
  misc_feature (1)...(700): n = A,T,C or G
tttggcataggcatgaacacatggcgccattcacttatgctttccttctgatagaggatccatttgcagatgggagttgtggttggccttctctgagcctaacctggaatctcaatggattaggatttcttctgaaagagtaagatgaggaatggtgggtgtgctgtgtgtctaatcaagtatggcgggcaaaaaactgatgaactggcattatcttagacttagaattctgtcagataaggcttatgtttttttgggaaagcatttgtatttcctttgttttgcttgctttgtcttagtgaatttccatttgagcactccagtggggtgctcaaaagcanggcaggaagaagaccggcagagctggggtacagatgggtgctaatcctccagcacagtctaggctgcatggctgagctgggagacggtatcggaggcttctgttgtggactgaggtttactgccagtggggtttgtctcaggttgtgcctatttctgggctgatgagaagacagtagctggcccctttcccatgtcagcagcccagcctgaggttttggccatgtgtgccatattcatttttgtatcctgagtgcctagatcagtgcctggcatctgcaggtcttcagtaaatatttgtgaatgaatggtgacgggccagtgagaacagtgtctgccaaggagccttactacaggaaga

SEQ ID NO: 2016 - DNA, 700 bp, Homo sapiens
ctgatgagaagacagtagctggcccctttcccatgtcagcagcccagcctgaggttttggccatgtgtgccatattcatttttgtatcctgagtgcctagatcagtgcctggcatctgcaggtcttcagtaaatatttgtgaatgaatggtgacgggccagtgagaacagtgtctgccaaggagccttactacaggaagaacactgtctacctaggagactgtctcctctgactgctctttctctggcaggtgcagactgacaagggttagttttattcctcttctggctggccatctgttgtacaccttagtttgggtgttggtactctggaggatattgtgtcaaattatctttctgttattgtctctcatgtactgttgcctccttgtgggcagggactggttccccaaaacctggcactgtcctggcatatgtgttggaaggtaagatagaaacaaacagcagtctgtgaaataagaaggagtgggccagaatcttggactgacagaccattggaacccgagctgactgtaccccactgcgattccgccttctcatggtacaggtggttgctgggagttgagaggatgggctctctccgcagggcacgtgacttcccagagcagggaccagaattgagcacacatcactggctgcacgctctttgttctttctgctgtttgtcctttttagcttct

SEQ ID NO: 2017 - DNA, 700 bp, Homo sapiens
  misc_feature (1)...(700): n = A,T,C or G
ggactgacagaccattggaacccgagctgactgtaccccactgcgattccgccttctcatggtacaggtggttgctgggagttgagaggatgggctctctccgcagggcacgtgacttcccagagcagggaccagaattgagcacacatcactggctgcacgctctttgttctttctgctgtttgtcctttttagcttctgtgtgctaggccaggattttgatatgtttgattatctgcatatgtgtgtacatgcctatgtgtctcctcacctaaattagtctttttcactttnttgatccagtgattgtcattgaatgcctttcagacacttccctctgtgaccatgaaactctgggtgtctgcattgctgatggcctggtttggtgtcctgagctgtgtgcaggccgaattcttcacctctattggtacgtgccaacaggactgtcgtctccctgacaccttgnctcacatgccacggatgtctctggctgcagcctgttctcatttagagtgggatagccttaactactggttttggccagttctgaggagagtggaactggcagagttgctgttttcccctataagatcccaatgatctggatgttcagggagccagatgtctgaattgggtctttcttcctgggaagtgcaggctgcacttgggctctctggtctttttgaccaccttgcccatg

SEQ ID NO: 2018 - DNA, 700 bp, Homo sapiens
  misc_feature (1)...(700): n = A,T,C or G
ttctcatttagagtgggatagccttaactactggttttggccagttctgaggagagtggaactggcagagttgctgttttcccctataagatcccaatgatctggatgttcagggagccagatgtctgaattgggtctttcttcctgggaagtgcaggctgcacttgggctctctggtctttttgaccaccttgcccatggaccagagagtggttctgagcagcaaatcctttgtatcctgaggatcaagcttttcctatccttccgacctaaagttcagagctttttatcctgtggtgagcccccaggatatccatgccccagtgtcatgaccagctatgtaacagtcggagaatgagatttagggctgcttcttgagtgacatccagtgcacttatctcaaacatccccttggtgcctctgcctctttcttcctgaagttgcgagatagagccccatgagtgcctaggccccctttaactccaagtccccataatccncagagagctgacatgttcttatcccaggggacttgcttctgtgctggtattcnnngccccaaggaaggaggctggacatccctcatctgtttctcactggtgtctttcttctctcccttgcagggcacatgactgacctgatttatgcagagaaagagctggtgcagtctctgaaagagtacatccttgtggaggaagcc

SEQ ID NO: 2019 - DNA, 700 bp, Homo sapiens
  misc_feature (1)...(700): n = A,T,C or G
cagagagctgacatgttcttatcccaggggacttgcttctgtgctggtattcnnngccccaaggaaggaggctggacatccctcatctgtttctcactggtgtctttcttctctcccttgcagggcacatgactgacctgatttatgcagagaaagagctggtgcagtctctgaaagagtacatccttgtggaggaagccaagctttccaagattaagaggtgtcctaagtccccanccatccttagttggccttccttcccttctgcccctcaaggaacaaggaagccatccaggntgcctataagaggaaacctttgagaggntgatgtggggctggcctggtnncttcatgccagtgcttgagaggagctaagtacatgggctaaggagtcactgtttattttntatttaagacctnttcccttacattgggggtcccagctgttatctagattaaggggctagaagtatctgtggggagttactgtattcatttttcattgcctcttgatgaaaagggccccagaacctggcaccagggaattctcactaggaaaattgtcacaggtcaagacctatgtgggtggacgcattagtcttccttttcctctggttccacagctgggccaacaaaatggaagccttgactagcaagtcagctgctgatgctgagggctacctggctcaccctgtgaatg

SEQ ID NO: 2020 - DNA, 700 bp, Homo sapiens
cattgcctcttgatgaaaagggccccagaacctggcaccagggaattctcactaggaaaattgtcacaggtcaagacctatgtgggtggacgcattagtcttccttttcctctggttccacagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggtgagggacggtgagcaggtgcttgagtgagcccatatgtttgtgtgctcatgcctgggttgttgtgtctgagcctgtcttgggtctgggtgttggtgggcaagtacattgtggaaacaggaccctgctggtctcatggctctctcccttctctgtggggacctggaagttggctggccttggtttttaacatgtaatgatgttcagttctttttttagcgtcttttttttagtgtctgtcttttcttattttttgctaatgacatttttccaattatactttagtgatacatgtttatagaaaagtcggaaaacacaaaaacaagagaattataattcttaatccagttgcccagtggtgagcattattaaaattgtagtttttctacctatgcatatacatttaaaaaatggaactatacata

SEQ ID NO: 2021 - DNA, 700 bp, Homo sapiens
ttttttagtgtctgtcttttcttattttttgctaatgacatttttccaattatactttagtgatacatgtttatagaaaagtcggaaaacacaaaaacaagagaattataattcttaatccagttgcccagtggtgagcattattaaaattgtagtttttctacctatgcatatacatttaaaaaatggaactatacatacataccagggcatgcaaactcagttgcttggagggacaatgaatttacaagtgtcaagtgggctggatggtggggccagggcaagttggggagcataggtctgatctaaattcattcctattcatatgttttacaaacaaagcatatctgttggtagatttgtgacagaagaaaaaattctgtgaatttctcagcttctttatatgccattcaatgttcttctgcaacatgattttaatggctggatggtgattacctgtcagatggtgataatctgtcatactgataatactgtcaaatgggtcaagtcattggatatgggattttttctgaattatcagcacctttttacatatttcttggtgtatacttctgattacttttttagggtaagttcctagaagtgatattaccgatgagagtgtgaactttttaaaagctttaaactatacttggtgcttttattgtgataatactttttatgccctaatacttttctg

SEQ ID NO: 2022 - DNA, 698 bp, Homo sapiens
  misc_feature (1)...(698): n = A,T,C or G
gggtcaacattggatatgggattttttctgaattatcagcacctttttacatatttcttggtgtatacttctgattacttttttagggtaagttcctagaagtgatattaccgatgagagtgtgaactttttaaaagctttaaactatacttggtgcttttattgtgataatactttttatgccctaatacttttctgtcaataagaagagatggtacggtgggcctggaggtgggctctcctaactcctagccctgggtttagtcccctggactcactgacttttttttttttttttttttttttgagactgagtctcactctgtcaccaggctggagtgtagtggcgggatctcggctcactgcaacctctgcctccgggttcaagcaattcttctgcctcagcctcctgactagctgggactataggcacatgccaccatgcccagctaatttttttttggtatttttagtagagacagggtttcaccatgttggctaggatgttcttgatctcttgacctcgtgatccacccatctccacctcccaaagtgctgggattacaggtgtgagccaccatgcccgctgcctttttttttttttttttttttttnnnnnnnnnaagggacagggtctcnctatnttancctanactggagtgcagnggctattcacaggtgcgattgtagcacactgc

SEQ ID NO: 2023 - DNA, 700 bp, Homo sapiens
  misc_feature (1)...(700): n = A,T,C or G
ctaggatgttcttgatctcttgacctcgtgatccacccatctccacctcccaaagtgctgggattacaggtgtgagccaccatgcccgctgcctttttttttttttttttttttttnnnnnnnnnaagggacagggtctcnctatnttancctanactggagtgcagnggctattcacaggtgcgattgtagcacactgcaaccttggactnctggcctcacgtgatcctcctgcctcagcctcctgagtagctgggactataggcacagtgccattgtacccagctnttcactgcctnttttccntgagctgngagtgctgattaacttcanactagctgtctctctggctganacattttancccatgtggccanactgggttgggcctgggggcagggtggcctctgganagggattggtgagctcanccaggctggagctgtgcccagtgagctcactgcctccanaaaccacggntgcctttcccanactcccgcctntccgcctgggcctgcagctcgggacaggctgttctgcctgcacggnaggagactaagcctacccagatgacctcctctctccaatcttgttctcacaccctacactccaccatcatntggttcctttggaaaacctnntgattacctggaaggagatagggcaggcccagagaataattggtngnnttcatctctga

SEQ ID NO: 2024 - DNA, 700 bp, Homo sapiens
  misc_feature (1)...(700): n = A,T,C or G
ctntccgcctgggcctgcagctcgggacaggctgttctgcctgcacggnaggagactaagcctacccagatgacctcctctctccaatcttgttctcacaccctacactccaccatcatntggttcctttggaaaacctnntgattacctggaaggagatagggcaggcccagagaataattggtngnnttcatctctgactttgagttcttgcccctgaaacgagcagggcatgctgacagtgtggcttttcctggcagcatgttcccctactcccaccccaccagattntaaactctttagagtccctgaccatgtagctatgaagacaaggaaggcagggttacagcttcttggtccctgtccccagttatggctgaagtggatgtttaggtctgaagtcataggtggcagtggatacagctactcttgggaagaggttggggaaggaatggccttgttgttcccctctcacttctcagcttagaggcagaattgaaggccctaagtcagcctgggaaggcttggctcccacctgggattgtaggaggtacacatcttactttacagctagggcttggagtcccagaaaagcctccttggagtacttctgtggtcaaaagctctcccacgcttcaggctgtggtcttgagcaccataactggagagcccatgccctgaactcattgaaggtctgagt

SEQ ID NO: 2025 - DNA, 700 bp, Homo sapiens
  misc_feature (1)...(700): n = A,T,C or G
ggccctaagtcagcctgggaaggcttggctcccacctgggattgtaggaggtacacatcttactttacagctagggcttggagtcccagaaaagcctccttggagtacttctgtggtcaaaagctctcccacgcttcaggctgtggtcttgagcaccataactggagagcccatgccctgaactcattgaaggtctgagtggtgggagtacagaggagaacagncccaccgtggtctcttaggggacggaccttgctgggttggtgcaaccccaccttggtccttggcctgtctaggtggtccttcagctgtcaacctagggggagggggatgacttccaggactttcatcatcacctttctggatgataagtgccagtggtcagtaatgagtggccagctcggcttcattagttaactgtcattgtcccttggactcctcaacttgaaatgtgtgctggaagtctgtgtttacctgactagcccaattaccctggatcaaggttttccatgggatttattttccactgagtggttgacagttcttcctgagtcctctcccgtgctcttctcagttaccctctctatcctctgtttcttctgtctccaccagctctgactgaatgatttggagccaagacttctggactcctaaatattaaccaatatggggggctgcttctacttagttccaaagagca

SEQ ID NO: 2026 - DNA, 700 bp, Homo sapiens
  misc_feature (1)...(700): n = A,T,C or G
aggttttccatgggatttattttccactgagtggttgacagttcttcctgagtcctctcccgtgctcttctcagttaccctctctatcctctgtttcttctgtctccaccagctctgactgaatgatttggagccaagacttctggactcctaaatattaaccaatatggggggctgcttctacttagttccaaagagcaacacaggcagtaggtatggtgaggagtaagaaaggaaaagtccccatagactggagtcatcagggacaacttcctggtggaagggggcaacagcctttgagggagggggcggggaaatttcactagccagagaccctctttgtggctgcctctctggtcccaagtggaattctgcccctggatcaagggtaatctcttgttctgactctcatttggaaggttttatcgccaacctctctgtgcagcggcagttcttccccactgatgaggacgagataggagctgccaaagccctgatgagacttcaggacacatacaggctggacccaggcacaatttccagaggggaacttccaggtaactcaccactccaggcgttgcctgtcccgcntgtgtctctttagtggcgggacaggttggagccaccaccaacttgtggcctttaacctcgggtgcacctctggtgcacctcttggctcaccagtttgtgctggactccc

SEQ ID NO: 2027 - DNA, 700 bp, Homo sapiens
  misc_feature (1)...(700): n = A,T,C or G
gacttcaggacacatacaggctggacccaggcacaatttccagaggggaacttccaggtaactcaccactccaggcgttgcctgtcccgcntgtgtctctttagtggcgggacaggttggagccaccaccaacttgtggcctttaacctcgggtgcacctctggtgcacctcttggctcaccagtttgtgctggactccctctcccatgacaggtttctccctcagcccctgccctgccacctccctccatgtattagccaaggccctctcctcttgcatctcagagaaagccaaagttgctgctcaggaaccccctccacgtctgtccccagagcaccacacagatctgcattcagacctgcttcttgtctcccaccctccaatgtcttttcatctaaggctgatctgggcttactatccccctgtcttgagtcctcttagttacagtctctgctcctatacattctgtctccacctctctgggttctacccttgagctcccatataggctctattcttgctcatcttaacacttgcctccctcggtatctgagagtctttcgagtctttgctgctgattcatctcttctcccctcctggttaggctactggatagagtaatctacactctgtccattttcctggttcccatatactcctgaactcacagtatctggcctttttccccactgtcactga

SEQ ID NO: 2028 - DNA, 700 bp, Homo sapiens
  misc_feature (1)...(700): n = A,T,C or G
cccatataggctctattcttgctcatcttaacacttgcctccctcggtatctgagagtctttcgagtctttgctgctgattcatctcttctcccctcctggttaggctactggatagagtaatctacactctgtccattttcctggttcccatatactcctgaactcacagtatctggcctttttccccactgtcactgatgctgttcttacaaggtcatcagtggcngcttggctggtaaacccagcgaacaaggttcacacataatgttctttaacttcccagcagcatttgacagatagattgcctcattctttgtgatgttctctcctcctttgaattctggcatactgatatctgcttctcttttagcctctctggtcattttctctcaagtggcccctctcccactgacttcccagtgttagtgtttataagaagatgttttgagggctgctggagacaagtaaccccagcgattcactgtgtgaggctcatgcagacccagcttattccagctccagaacctcagctgccccctttagactccattagagagagggcagttcagggcacctgcaagatctgttcactctgtagccttgagattggttgcttggaggagggaaccataccctggcgttgacctctcacgttcactcagcaaacccatgagtgtcctgaatagggttatggggca

SEQ ID NO: 2029 - DNA, 700 bp, Homo sapiens
agacccagcttattccagctccagaacctcagctgccccctttagactccattagagagagggcagttcagggcacctgcaagatctgttcactctgtagccttgagattggttgcttggaggagggaaccataccctggcgttgacctctcacgttcactcagcaaacccatgagtgtcctgaatagggttatggggcagaaaggaattactccctaggactccatccttacctcatcttctccctgagcaccttccccaggtgagcacagccatttccatcacctgaggtggatgacatccagatctgtgtttcttgccaaggcttgtctcccgagcttctaaccagtgtagacggatgcctttgggacatctgtacttgaatgtcccatggacttctcgaacttcatgtgtcctgaactgaaatcctcatctccttgtaaacactttaccttccccctcatccttctatctcagcaaaaaggacctccatcctctggctgcctaagccagaagcctaaggcctatggattctacctccttctctcatgtcttccgtgcttatcccctgactccagcctcacagctacttttttctcaatttgattatcaaaataccattctgacttgtctcctacctccagcttactgcttaagaccatcctccatgtggtcttaagcacacatttgttcacatgag

SEQ ID NO: 2030 - DNA, 700 bp, Homo sapiens
ctgcctaagccagaagcctaaggcctatggattctacctccttctctcatgtcttccgtgcttatcccctgactccagcctcacagctacttttttctcaatttgattatcaaaataccattctgacttgtctcctacctccagcttactgcttaagaccatcctccatgtggtcttaagcacacatttgttcacatgagttcctgattactgtgcttaatttccaaagctaaacccaaactcctcctgtgtgtggtctttggggtcctgcatgactccattttcctggcttccttgcccattgtactcagctttccctatcactcagctcttttgtctcaacccctctataggaatacctttacccatgtcagctaggctactccatgtctgattgcctatcagcactcagctcagctgtcactctcccaaatgctctccagggagtagacattcgagttggctctggggaggatgctgagtgccagggagccattcttagcattcttggcatctgggagacatgttgataatagctactggtcattagcatcctggggagcataggagacatcttcatatgtcatcttattgaattcttgccacaagctctttaaaattgatgatattatctttatttagagataaggggactgagacttagatatggtaacttgtctatagtcacacagctggttgg

SEQ ID NO: 2031 - DNA, 700 bp, Homo sapiens
agcattcttggcatctgggagacatgttgataatagctactggtcattagcatcctggggagcataggagacatcttcatatgtcatcttattgaattcttgccacaagctctttaaaattgatgatattatctttatttagagataaggggactgagacttagatatggtaacttgtctatagtcacacagctggttggcgccctagtgaggccaacacaaacctagtttagttcagctccagagccccagctcagtcagctatgttactctgccccagcaatgtaggttcctgggcctgcagagccagaggagacctgtggagaaggaaaaggggctccaggagccccccagtccctggcctacctagggacttcatcttgtgtttactgtccccaacttcctattcctcgttattggttcctgagccaccggggttagcagaccctggtctctgaagcatttagcctactgtgtagtggtttcattccaggcagaaagagccttctctgagttcttttgtgtcagccatgcccaggttgctgttaatggggctgtggggagtcttccttgctttccagggagagtcacagcccccacttcccctccatggtatctgctttctcattattctctgaggaaccacacacatagtctttcccatcttgagctcaccctaaatcctgcatctccctatagc

SEQ ID NO: 2032 - DNA, 700 bp, Homo sapiens
  misc_feature (1)...(700): n = A,T,C or G
gagccttctctgagttcttttgtgtcagccatgcccaggttgctgttaatggggctgtggggagtcttccttgctttccagggagagtcacagcccccacttcccctccatggtatctgctttctcattattctctgaggaaccacacacatagtctttcccatcttgagctcaccctaaatcctgcatctccctatagctgcttcttcatattggcttgaaactatcttcatggtcactttccagcactccctctacagcagatgacctttggtcataagacccactgaactgatactcagcaaggtccctgccacttaacagccaaagctggcactgcaaccttggctcttggcctcccttggtgtctctcacaccactcccgctccctctgtttctcctatctttagttcattctcagggttattcattgtctgttctttctgggtaggtgctccctggagctctggccttagtcatcttctccattctttcctnagagttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggc

SEQ ID NO: 2033 - DNA, 700 bp, Homo sapiens
  misc_feature (1)...(700): n = A,T,C or G
agttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggccccttcccacttgggagatggggaatctgaggctaagaggtggctgtgaaccccagtccagggcagggctgggccatctgtctgtgctcactgtgtcagtggccctttaggatatgcagtctaaatgtccgatggagttctgcttggtgatgccccctatccagtggctcaggctttccttgaagngggaatctctttccctaatccagaggctctttggagcctgacaatttacttcccctgctgtaggaaccaagtaccaggcaatgctgagtgtggatgactgctttgggatggccgctcggcntacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattc

SEQ ID NO: 2034 - DNA, 700 bp, Homo sapiens
  misc_feature (1)...(700): n = A,T,C or G
ctcggcntacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattctaggggaaggtaagatnggaatggagagtggnanaggaactgcactgtgctggcatctgcctgacccctctcctgggactgagtcagtttaccctgtcacttggccagtgactaatgccttactgactttaggaccagtccagcttcttactagctccttacccacctcaatcctggccttaggtttgcgcagtcgctgatagatacgctcaggcctgtggcacttgtgggcctttttaataaggactctgttatggtgtatctgtcaccatgcaggactacacagggtggaacctttactacatcaggagcagctcaggagtcaggttgtactttaggattgttacagtgacaaacagtagcggtgctattagaggcctgaggtctaatagtaggacttcatatggcattgatactttgtgtgccttgtgctgttggactgaagaaggccaaaagcactgtgcctttaaaactcatctacctttttttttttttttttt

SEQ ID NO: 2035 - DNA, 700 bp, Homo sapiens
tacatcaggagcagctcaggagtcaggttgtactttaggattgttacagtgacaaacagtagcggtgctattagaggcctgaggtctaatagtaggacttcatatggcattgatactttgtgtgccttgtgctgttggactgaagaaggccaaaagcactgtgcctttaaaactcatctacctttttttttttttttttttgagacagagtctcactcatccagcctggagagcagtggcacgatctcagctcactgtaacctccgcctcccgggttgatgagattttcctgcctcagcctcccaggtggctgggattacagaggcacatgccccatgttgtattttctttagtagagatgaggttttaccatgttggtcaggctggtctcgaactcgtgacctcacgtgatccacccgcctcggcctcccaaagtgctgggattgcaggtatgagccaccgcacctggcctctgttggttttccagttacgaccagcgtactctggttagatgctgtggaaggtagaatgcagcatgcaggtgagctgctgggagagaaacccttacagaataatttctctaaatgacctaacagatgtttgtggtttccttttccttctcattccttgcattttctagacccaagccacgaacgagctggagggaatctgcggtactttgagcagttattggaggaag

SEQ ID NO: 2036 - DNA, 700 bp, Homo sapiens
actctggttagatgctgtggaaggtagaatgcagcatgcaggtgagctgctgggagagaaacccttacagaataatttctctaaatgacctaacagatgtttgtggtttccttttccttctcattccttgcattttctagacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactggtgagatgtgtgagggggctagggtgccaaagctgtggacctggactctggctctgggcaggcagatttggggaaggtgttctttattctgtaggtacttttctcagtatatcccccagtttttcatggcatctcctgaggctgacatgtggatattctctgaggtgtaggaaaggagactctctcccctcgtgccccaggtagagtgttgctcctctaagttaccagtgagctcgcctccttaccccaatatgtcccactttttgcttcactcactgttgggaagaaaacaatgggtggacgtacctcaggccccaaaagaagtcatggtataagtggagagtaagtctctgtggtaaagacacc

SEQ ID NO: 2037 - DNA, 700 bp, Homo sapiens
  misc_feature (1)...(700): n = A,T,C or G
gtaggaaaggagactctctcccctcgtgccccaggtagagtgttgctcctctaagttaccagtgagctcgcctccttaccccaatatgtcccactttttgcttcactcactgttgggaagaaaacaatgggtggacgtacctcaggccccaaaagaagtcatggtataagtggagagtaagtctctgtggtaaagacaccagcgtgtactagagcttggtatcgagcctttgagagccctgggatcctagtgcttcctgaggaggcccaggtgtgacaggctctgagccttttccatgcccctgtctgcatggcttctactggctcctccaccaagaaaggtttctcccctgtcccagcccttcagacctactcaagtcttcacgaaaagggtcaggaattactttctgccatgggacttgaggatgtgaggtgattttgggagagaagaaaaattgcatgatttgtggggtgttatttcatgccagttaagctgaaggggctctcctctcctctcccctccccccattcccccctctcctcccctcccccctcccctccccctcccctccccctcccctcccccttctcctcctctctcctcccctccctccctcccttcctttcttccttcctttttcttctctttttcctgtttcctnnttttccttttntttnctttctttcgtctcancctgtcg

SEQ ID NO: 2038 - DNA, 700 bp, Homo sapiens
  misc_feature (1)...(700): n = A,T,C or G
gctctcctctcctctcccctccccccattcccccctctcctcccctcccccctcccctccccctcccctccccctcccctcccccttctcctcctctctcctcccctccctccctcccttcctttcttccttcctttttcttctctttttcctgtttcctnnttttccttttntttnctttctttcgtctcancctgtcgcccaggctggtgtgcagtggtataatcatagctcactgcagctttgacctcccagccttgagcaatcctcctgcctcagtctcctgagtagctgggactacaggtatgcaccatcatgcctggctaattttttagagacaggtctatgtcatctaggctggtcccaaactcctggtctcaagctatcctttggccccncagagttctcggattacaggcatgagccactgtgcatgcccacctgctgggacttttgttttcttctgtggtgtggtgggagggagcagctgctggccatgaggtgagtccagtgtctgcagacagccagactgggaccgaggattaggactcactcagctcagggcctgttactctgtgctttccagacaccccgtagacagaagaggcttttctgtaggtaccaccatggcaacagggccccacagctgctcattgcccccttcaaagaggaggacgagtgggacagcccgcacatcgtc

SEQ ID NO: 2039 - DNA, 700 bp, Homo sapiens
ggtgagtccagtgtctgcagacagccagactgggaccgaggattaggactcactcagctcagggcctgttactctgtgctttccagacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaagtaggtgtcactgtaggtccttctcgggtcactgaagggggaaggtcctttttctcatccctagcactatgggtggttggtttgcccatctagccaccctttatccatatctagcatgggcctaccgtggggatacagagatgcttcagactcagcctgaccttgtgagttcatggtccagtggaagaagaacagggtaaccaatgtggacagccaagtgctatcatagaaggtcacgctgggaacagggcaggtctacactggtgtgtcagttcacctggttgggagactggtgcgtgggtgagttttttggaaatgttccataggatgctatgaagctgggtcctgtggagctcctgattaggactgtaaatgaggtgaatgacttagaggagaatgtatatctttataatattgggtcttctcatccaagggca

SEQ ID NO: 2040 - DNA, 700 bp, Homo sapiens
gctgggaacagggcaggtctacactggtgtgtcagttcacctggttgggagactggtgcgtgggtgagttttttggaaatgttccataggatgctatgaagctgggtcctgtggagctcctgattaggactgtaaatgaggtgaatgacttagaggagaatgtatatctttataatattgggtcttctcatccaagggcatgacaggtctctccatatctttttaagttttcttcatataagccttgaacatttcttaagtttattccttggtagtttctttgttactgttaatttactttatttcttcattattatttttaactggttacattattttattagtttactattatatgccaaactattgattttacaaatacatttcatagtaagagctaatgtttactgaattcttaactgtggcaggaacttctaagtgcttaacatatatattaagtgttatgtcacagttatgaacagctgctcataatgatgtcactgtctctgttttacctatgaaaaagcaaactcatacagattgcagctagtggttgaatttacttatttcttttttggtttttagctgatttctctttggttgcctggatagcattaacacctggaaataaggaaaattttattttctcctgatacttgtagttcctttgtttttataaccttattgaattgcccagaac

SEQ ID NO: 2041 - DNA, 700 bp, Homo sapiens
ctgtctctgttttacctatgaaaaagcaaactcatacagattgcagctagtggttgaatttacttatttcttttttggtttttagctgatttctctttggttgcctggatagcattaacacctggaaataaggaaaattttattttctcctgatacttgtagttcctttgtttttataaccttattgaattgcccagaacttctagagcataattacgtagaataggcatccttgtctcattcctgaatttcctggaaattcctatggtattttactgctaagaatgcagttggctgttggttttgtatatatgccatgttttaaaattattcttctgtttctagttcataaaagatttgttccccatttgacatctttcaaagagacctatttgctgccatatcccatcactgatgattgggagggaggatttagctcgattctctattgctctgctcctaatagaattgtaggggccgaggtgaccaggaggcccgacactcatggagagacctgaaataggttcctatcctggcccctggacctcatcttggaacagctttggcttgaggtactaggacatctagggctttgagtcagtggttggcatcatcgatgtggctgaggaagggggctagccagatatatggagaatggggactaggactcccctttctactcagctccagagtcctccag

SEQ ID NO: 2042 - DNA, 700 bp, Homo sapiens
  misc_feature (1)...(700): n = A,T,C or G
actcatggagagacctgaaataggttcctatcctggcccctggacctcatcttggaacagctttggcttgaggtactaggacatctagggctttgagtcagtggttggcatcatcgatgtggctgaggaagggggctagccagatatatggagaatggggactaggactcccctttctactcagctccagagtcctccaggaaagaaaactactttgttggttgtgccaggatttcctgagagatttcttacccgttcttcagttccagacactgagaacatttctctgtgcatgtgtgcatatgtgtacacatgtgtgtggctggccagngggtagtgttaggaaaagatatatttgaatagaagccatgcaaagagccaaacaaggttggcaaacatgtttggctcttaacatggcttctattcaaagataagctgacccctcctttccggagactgtgagggacagatgctattctggctttgaagtagagccaatgagcttaacttggcctgtggggaatgcctggcagctgtctgtggggtctctggcctgctttcaaaatagccctgtgcttcccctggggcagagcacagctgctcagagcctctttgtgggtgtcaggccaatgctgaggcacagatgtttggatggggtctggctgtggctgcagttttcagggagggactgacatgagct

SEQ ID NO: 2043 - DNA, 700 bp, Homo sapiens
agcttaacttggcctgtggggaatgcctggcagctgtctgtggggtctctggcctgctttcaaaatagccctgtgcttcccctggggcagagcacagctgctcagagcctctttgtgggtgtcaggccaatgctgaggcacagatgtttggatggggtctggctgtggctgcagttttcagggagggactgacatgagctgaagctcaggaagggccatgagtaggagcttgggagccgtctgtcctgcttgtgctggccatcttaccagatcatgccatagcagcacagtgtccaagttggtccatctcacccccttactagccttctggtccatctactcctctccatcccttctgccaccacctggcccgggccaccatcatctcttgccctgacctctgtcgtggcctcactagcctcccagtccccactctggcccctcattagtcaactctccatgaggtattcacagtgatccattttacattcacattttgagtgtccctcccctgcataaagccttccccatttctcgttggccacaaggttgcatctagttcctagcccctgcttgtctcttcagcctgttctctcttactacttcccataacctttaatccacacctactgcaacacccattttcattcccaggcctctggattgctgctctttccctgttcctgtaatgttcctctac

SEQ ID NO: 2044 - DNA, 700 bp, Homo sapiens
  misc_feature (1)...(700): n = A,T,C or G
gtgtccctcccctgcataaagccttccccatttctcgttggccacaaggttgcatctagttcctagcccctgcttgtctcttcagcctgttctctcttactacttcccataacctttaatccacacctactgcaacacccattttcattcccaggcctctggattgctgctctttccctgttcctgtaatgttcctctacttggataactcatgttaacccttcaggcctcagctaggtggtctcctcccctaggaagctattcttgacactataccctnagcttccanaggatggtaagttcacccatgctgtgctgcagttacctgactggttttctgctttccccacttgactgagttgtaagagtgcaggggccatgtctcagttacctagcatagtgccaggcacaaagtaggcactcatcaatatttattgaaatcaaggggaagtgtgttggggtgggagtacctgggcctatggccccacccatgtgaggtcatgaggacagtccacagctgaagcacatggacctttgccatgttggctggctctgggcggcgagtcccccttggggtttcactaagcctaactgtggaggctgggggagatgaagtagatgcagggagtgcatgtgtagtgtgtacctgtatgagtgggtggcttccaggcagtggttcacttattttaacttacagaat

SEQ ID NO: 2045 - DNA, 700 bp, Homo sapiens
  misc_feature (1)...(700): n = A,T,C or G
atgaggacagtccacagctgaagcacatggacctttgccatgttggctggctctgggcggcgagtcccccttggggtttcactaagcctaactgtggaggctgggggagatgaagtagatgcagggagtgcatgtgtagtgtgtacctgtatgagtgggtggcttccaggcagtggttcacttattttaacttacagaatcttttcctggttttatcatctgacttgtaaggatcccaagggagcgaaaactgtgccatctgtctttgcttcttgaggctgtgggaacccagtgtgaggtggtgcagcaggagagtgtttggatgggtttcttggcagaggagcccactgaggttcggaaggatggtggaacttgactcaattgagagaagtacataaggcggaggctcaggcatggtggcacagtctgaaaatggtgggagtagctaagctcaggcaggctgtgctcaggcaggggtggtatgtgggcctggcaaggaaaggggctagtcaggcagatgcatgggtagacaaggcaggcataattctgcaggcaaagcggacctggggaggagaagggatgagcagtgaccgagcagggcaatagccagnaactgattgcggattgggaatgtggaggcctcagactcttgccctcaactggcctgcaggatcttggggccttggctagagccattggc

SEQ ID NO: 2046 - DNA, 700 bp, Homo sapiens
  misc_feature (1)...(700): n = A,T,C or G
aggggctagtcaggcagatgcatgggtagacaaggcaggcataattctgcaggcaaagcggacctggggaggagaagggatgagcagtgaccgagcagggcaatagccagnaactgattgcggattgggaatgtggaggcctcagactcttgccctcaactggcctgcaggatcttggggccttggctagagccattggctgcaaagcttcctccactagcatggcagtaaatctggtcccagtgctctctgggaaaatattcaaggcaaaacaaacaaacaaacaaatcaagtcttccctctcctccttccttctagcttgcacgagccaccgttcgtgatcccaagacaggagtcctcactgtcgccagctaccgggtttccaaaaggtaagcaaagagcaggggttcgtagctgctcaagccccaacttcaggacttctcagtgcctaccctagggatgggtggcttgccttttcctgcctgctggcacctcctcacccccttgcagcaggcatcctgtactgcctgttcatgctggccctgactctggggacagagttcaggacctcatggaagcctgcccttccgtcttcttttctctgcccttttctttttgcccagctcctggctagaggaagatgatgaccctgttgtggcccgagtaaatcgtcggatgcagcatatcacagggttaacag

SEQ ID NO: 2047 - DNA, 700 bp, Homo sapiens
  misc_feature (1)...(700): n = A,T,C or G
ccccttgcagcaggcatcctgtactgcctgttcatgctggccctgactctggggacagagttcaggacctcatggaagcctgcccttccgtcttcttttctctgcccttttctttttgcccagctcctggctagaggaagatgatgaccctgttgtggcccgagtaaatcgtcggatgcagcatatcacagggttaacagtaaagactgcagaattgttacaggtacagatagtacctgggactgtaggagttgggaagtgggtatttgtggctagatggtctcacagggtgtccagaactgggccaagaggcccaactgtatgactactgcctgatgctatgaatatggagtgatctcattttaggaaaccagaattaatcatgcctgctggctttcaacaattagtgttcaacaaatatctattgagcatctnctgtgtgcccaagtgtgctgcaagctagggatcaggggtagttatggtaggttcgttcatgtcttcttgacaacagaagctcaaatcctgaatggtctcagggacatctctaagagagctaaaaatgacttcagaggccatggttctgtgtcataatcaaatacatttgaaggtcaaagtattctgtgtgttttctcctgctgnaccacaactgaagttgctccaaaagcagcagcaggggacttcccatgagggactgccaaga

SEQ ID NO: 2048 - DNA, 700 bp, Homo sapiens
  misc_feature (1)...(700): n = A,T,C or G
cttgacaacagaagctcaaatcctgaatggtctcagggacatctctaagagagctaaaaatgacttcagaggccatggttctgtgtcataatcaaatacatttgaaggtcaaagtattctgtgtgttttctcctgctgnaccacaactgaagttgctccaaaagcagcagcaggggacttcccatgagggactgccaagatggggtcagttgagaattcaaagaaagcggcactaaacccctgggtcttcagtccacagcatttattagggaacttgcagagtgggctgcagcaatcctcaaaatggacagcaagagacaagaattgttttacctaagtatttccacagtgagggagtcagagtgtggagtttatttgagggtttagggaatttggttcagggctggggctagtttctttcagtgttatgggcaacaacctaaacaccttcatcagtgcctgggaatgttgaagactccagcttgtgttccagcctgaagggaaaaacctgcagctggctgggtcacagagctgtcaagggagtctgattttcagtcagaacaaagaaagaaaggcggggtgggtctgggggaccttacactgtgatatgtaggtggaagtgagaggcctggactggttaagctggtgcaggtggaatgttcttgtccaagtactcccactgggaccctggcttcctgcc

SEQ ID NO: 2049 - DNA, 700 bp, Homo sapiens
  misc_feature (1)...(700): n = A,T,C or G
ggaaaaacctgcagctggctgggtcacagagctgtcaagggagtctgattttcagtcagaacaaagaaagaaaggcggggtgggtctgggggaccttacactgtgatatgtaggtggaagtgagaggcctggactggttaagctggtgcaggtggaatgttcttgtccaagtactcccactgggaccctggcttcctgcctttattcagaggtgattttgaagaaatgtggcagcaccctgctgaaaggttttgggtaaagctccttattaaagtatcctcttgggtaaagcttagtaaagtgtcctcttgggtattgagtccaaatcagcactggctatgttcccttataaatattggaacttctgtgttctgttgtaaaattgatgacctgagacaccntcagagaagtttcactggcatctttctagaggcctctgggtctctctgtttggccaaagtttctgtatacttaaagatagcagcctttacctttaggattggcatttgggtctgatctaccatagatctcattagaatattgattaaagatcatttggaaaagattttttgaacttttgcttggacacgcctaagcaaatcagccttctttttgttgttttttctgtgtagctgcatcagcaattggaaaatcaattttgaaggtcatctttatggattggtgtgaagtctaccagagt

SEQ ID NO: 2050 - DNA, 700 bp, Homo sapiens
tggcatttgggtctgatctaccatagatctcattagaatattgattaaagatcatttggaaaagattttttgaacttttgcttggacacgcctaagcaaatcagccttctttttgttgttttttctgtgtagctgcatcagcaattggaaaatcaattttgaaggtcatctttatggattggtgtgaagtctaccagagttttaaaaagcatactgattaccttgcaaatagtactgtgaaattttaatttttttttcagttcagctcaacttagtgttttgtaatttttaaataaattctgcagataagcacatccatggaggacttctgcctcatctcccacttgctgcgtatgtgtaagagcaccaccatttcaagagtgataggcactcttgatgtgctagatgagtccctgttggcattgtcttgattcatatcttcttggagcaggtttttgtttttgtttttaaagacatctgccactgcttcctctgtgttagagccagtcttcaggactttcatggtcctgatcaaagaccacagtctgcttggctgatttcataccctggaccaagaggctgagtagacaggacctgtggctctgttgctttcctggctagctgtgcggctgtactcactgtatccctgtcttacactcacccgtggaagatagcagcttcttgcctatggactgacttc

SEQ ID NO: 2051 - DNA, 700 bp, Homo sapiens
gagccagtcttcaggactttcatggtcctgatcaaagaccacagtctgcttggctgatttcataccctggaccaagaggctgagtagacaggacctgtggctctgttgctttcctggctagctgtgcggctgtactcactgtatccctgtcttacactcacccgtggaagatagcagcttcttgcctatggactgacttctctgctacaattcagcctttatcttgtctggcctctcattgtgttgtagctcaattgtctggggcccgaatgccagacctcttggtagaggggctcttatagttaaggatcttctggaaattcagaccacagctgccaagtggttgagatgccatttttgtttgtattcttctcctaggaactgtctcgacatttcctttgccagtcagtggtattgaaggctttgatccttcatggtctggggaacaggaacctgggtttcagcatgtatccctaagtgcttactccatatgaaatgcttgtggtatgatacatgcctaggcaccagcaacagccctcacaccaggtcctttaggaaatgctgcaggcctctggaaaggagctggttcttctatctgttgacattctttcagctgtagctcacatgtttgctgtagatcatttgaaggaaaaaggtaattgaggctttctggtgaattggatgagggcttatctgatag

SEQ ID NO: 2052 - DNA, 700 bp, Homo sapiens
  misc_feature (1)...(700): n = A,T,C or G
tgtggtatgatacatgcctaggcaccagcaacagccctcacaccaggtcctttaggaaatgctgcaggcctctggaaaggagctggttcttctatctgttgacattctttcagctgtagctcacatgtttgctgtagatcatttgaaggaaaaaggtaattgaggctttctggtgaattggatgagggcttatctgatagagaggaagagatgctacacctctaggattctaaagattgaagactttggctgcatgatgtctcagcctcaccagaaaagtgatttctgacctttttaattttgcctttactctgtccttagcattgtaaatacccacntctttcaaataactgaccccactcttacaatagtaagtctaaagatttaagtgaatacctcctcacatgaatcggtcttgacgtacagtttcttgttattaaaggcgtgagcctggggacttgagtatgcctggatagggaatcttactgctgcaaatctagatggtcctatgcattttgtacttatttgggaactgtattaaagaaagtaggtacggtggcttcagaaccataatcaaatataattctccaaacctaaaagatgagccagctctcgcaatgcagcttctttcactgcctgggatttgtaaatttaagcaatccatttaacaagtggaagtattggaaaatgcagtcatact

SEQ ID NO: 2053 - DNA, 700 bp, Homo sapiens
atggtcctatgcattttgtacttatttgggaactgtattaaagaaagtaggtacggtggcttcagaaccataatcaaatataattctccaaacctaaaagatgagccagctctcgcaatgcagcttctttcactgcctgggatttgtaaatttaagcaatccatttaacaagtggaagtattggaaaatgcagtcatactttgcagctccagcaacaagcactaattgaattttcctgagtgtacctgcacagcagtcacagttgtgtttaaaattttcttccatgccaggtgtcgtggcttacatctgtaactcagtacttggggagaccaaggcaggaggattgctcgaagccaggagtttgagaccagtctgggcaacatagtgagactctgtctctacccccactccccccaaaaaaaaggagagagaaaaaaattttcttcaagctcttgactacaaaaagagatatgctttctcagctgctctggcacttctctccttagatgcatctccagccttagggccacctgctgaaccaggcttccttgtgctgttgacaggatttccaggtatttttggtacaggaatcttaaaggctgaagcaatggatgacaacatgttttcatccatgctttgtattaaaatttttatttttgtagacatggaaaatgatactgccaacattttgtgctctaat

SEQ ID NO: 2054 - DNA, 700 bp, Homo sapiens
  misc_feature (1)...(700): n = A,T,C or G
ccttagatgcatctccagccttagggccacctgctgaaccaggcttccttgtgctgttgacaggatttccaggtatttttggtacaggaatcttaaaggctgaagcaatggatgacaacatgttttcatccatgctttgtattaaaatttttatttttgtagacatggaaaatgatactgccaacattttgtgctctaataagaggatttcatctcttataaagtccactgtccctttctttcttgcatttctttttttgtgtgtatgtgaaacagggtctcactctgttgcccaggctngagtgcagtggcacagtcatagctcagtgcaaccttgaactcctgtgctcaagcaatcctncctgcctcagcttcctgagtagctgggactacaggtgcacgccactgtgcccagctaattttttcattagtagagacagatggggtcttgctatgttgcccaggctggtctcaaacttctgagctcaagcagtcctctcacttcagcctcccaaagtgctgggattacaggcgtgagccaacacgcctggcttctgtcccacgtttttataggtctctgttattgctagttttgtagcatctctcacctgactgttgggattgcagaaaaggatatacaaaaaataccaactttctgagaacttatggcctagccccagaggtttttatgttttcagtg

SEQ ID NO: 2055 - DNA, 700 bp, Homo sapiens
acttcagcctcccaaagtgctgggattacaggcgtgagccaacacgcctggcttctgtcccacgtttttataggtctctgttattgctagttttgtagcatctctcacctgactgttgggattgcagaaaaggatatacaaaaaataccaactttctgagaacttatggcctagccccagaggtttttatgttttcagtgagacacaatagccaactgttcccagatggacattggtggtgctacttgatccatcagcttccatgtcagattctgtgcttcatctttaaccttgtctctcattctgtctactgacgctgagacaataattgtgatttaggacttcccattgtgctgataagctgtccacaaaggcatttacaatttctaatccaatttatgacacctggtagttgctcagatgttacttcaggtccagggtcacactggggttgctgatgtagcacggtaattcttgactgcctggcagctggccacccatgttgtgctgtttcactccatgcagtagaccactgtgggagtctgccccactcagtctcaccaggaatagcagaggtggtaggaacagtgccaggtgctgagtacctccaaaactagtttaaaaaagaaaatcctcgtcttaaatttgttactcactttcctctggattactttcttaatatgtcccaaacaaactgggt

SEQ ID NO: 2056 - DNA, 700 bp, Homo sapiens
tgttgtgctgtttcactccatgcagtagaccactgtgggagtctgccccactcagtctcaccaggaatagcagaggtggtaggaacagtgccaggtgctgagtacctccaaaactagtttaaaaaagaaaatcctcgtcttaaatttgttactcactttcctctggattactttcttaatatgtcccaaacaaactgggtccaggccagggcccgcctcaagcagtgttccctttgctgctgtctgagtgtccatgaagggctggtgcttttcctcagtgatcatatgcagttcacccatcttgttttgtttgggaaaccacatttgtgccgcagccttactcttggacagaactgtagacttgtttgtgatgtttgctctgcctgtgctgccagggcatggttgtcttccaccttagagaggctgctcttgggagttctggttgttttcaggcctgggaagatggtatccctagagtgattggctgctacagagctgttcatgctgcttacaaggtctaatgctgttatttcccacaggttgcaaattatggagtgggaggacagtatgaaccgcacttcgacttctctagggtaaggcctaaatcacaggtgctttcaaagggccctgctctagctgatttgagaagggtggagcttctaggagcatttcagcctccacatcagtacccccacccctt

SEQ ID NO: 2057 - DNA, 700 bp, Homo sapiens
catgctgcttacaaggtctaatgctgttatttcccacaggttgcaaattatggagtgggaggacagtatgaaccgcacttcgacttctctagggtaaggcctaaatcacaggtgctttcaaagggccctgctctagctgatttgagaagggtggagcttctaggagcatttcagcctccacatcagtacccccaccccttgtcctccctccacctctgcatcaccaggggaaactcttcgttactggtgaatcccaaatctggaaccaagggtcctgcagaatgcagtggagcctggctgtctcccctgtagatgtggggcgttcgtcccctgccctaattctgtcaccctttgccctgattctaaagcaaagagcctcactaggtctttgtgaaaactgttcttgtcccttttcctcttccccgtctactccatgccctagccagaatttactttgcagctttggcacatattccaggctgatttatggaacacacacttattacttttccctgacccttttggtcctagtcttgtgggtggtggatgaagcctgttgtaaacttgggtgaaagttgttgtctgttgcagcgaccttttgacagcggcctcaaaacagaggggaataggttagcgacgtttcttaactacgtaagtactgggtccaggcccacctgttcattctcacttaattttgtag

SEQ ID NO: 2058 - DNA, 700 bp, Homo sapiens
tattacttttccctgacccttttggtcctagtcttgtgggtggtggatgaagcctgttgtaaacttgggtgaaagttgttgtctgttgcagcgaccttttgacagcggcctcaaaacagaggggaataggttagcgacgtttcttaactacgtaagtactgggtccaggcccacctgttcattctcacttaattttgtagaatgatgagcgagatactttcaagcatttagggacggggaatcgtgtggctactttcttaaactacgtgagtatgatgtgtgctgatgagccctaaggggaccctgggtccagagggctgccttatatcccacccccatcagggctgatctcatctgctgttaagtaatggtcaggtccttctggctctcagcacccttcttggctgcagtagggagagttggcctctgtttctattcattttccccactgccaccagcaggactttaacattcctggctcctatttttttccccagtgtttaaaattgtgataaaacagacataacataaaacttaccatcttaaccattttttaaatgtacggttcagtggtattaaatacattcatagtgcgcaagcatcaccaccattcatttccatctattttcatcatctaaaactgaaactctacccattaagcaataattccagattcccctcctgcagctcctggcagcca

SEQ ID NO: 2059 - DNA, 700 bp, Homo sapiens
  misc_feature (1)...(700): n = A,T,C or G
ttaaaattgtgataaaacagacataacataaaacttaccatcttaaccattttttaaatgtacggttcagtggtattaaatacattcatagtgcgcaagcatcaccaccattcatttccatctattttcatcatctaaaactgaaactctacccattaagcaataattccagattcccctcctgcagctcctggcagccaccattctgctttctgtcgctntgattttggttacttaaataaatggaatcaaagtattaacacttgtctttttgtgtggctggtgcataatgtcctcaaggtttatccatgttgtagcatattctggcttcttcttcttctttttttttttttttttttttttggagatggagtcttgctctgtcacccagactggagtgcagtggtgggatctcggctcactgcaacctcagcctcccaggttcgagtgattctcatacctcagccttccaagcagctgggattataggcgctagccacaacgcctggctaatttttgtatttttagtagagatagggtttcaccatgttggccaggctggtctcaaactcccgacctcaggtgatccgcccccctcggcctcccaaagtgctgggattacaggcgtgagccactgcgccctgccattctggttcctttttgatgggcccagtgctagtctggacttttgggatgggtg

SEQ ID NO: 2060 - DNA, 700 bp, Homo sapiens
  misc_feature (1)...(700): n = A,T,C or G
aacgcctggctaatttttgtatttttagtagagatagggtttcaccatgttggccaggctggtctcaaactcccgacctcaggtgatccgcccccctcggcctcccaaagtgctgggattacaggcgtgagccactgcgccctgccattctggttcctttttgatgggcccagtgctagtctggacttttgggatgggtgccctggagggttccctccttggcatcagagtgaggagatagccttagctctctctagatgagagctgcctttgtgttctccaaggcttaatggcctgattcccacctcttgcctctgttttatccataggttgtagggtttatctttcacatgaggagcagtttcctctcccctctgctgagagccagctctaaagaggcatagaggcagtaaagtaacttggagacagaagcctgtgtccattttttccctttatgcttttattgtgtggttattacatgctggggattgtgctgtgtacatgctggtgagcagaacatatgtggtctcncttgtgcttgaggtccaatatgagagacttattttaaacatcagagagattcttctttatctttttttttttttttttttgagacagactctccctctgttgcccaggctggagtgcagtggcgctatctcagcttactgcaaactctgcctcccaggttcaagcgatt

SEQ ID NO: 2061 - DNA, 700 bp, Homo sapiens
  misc_feature (1)...(700): n = A,T,C or G
catgctggtgagcagaacatatgtggtctcncttgtgcttgaggtccaatatgagagacttattttaaacatcagagagattcttctttatctttttttttttttttttttgagacagactctccctctgttgcccaggctggagtgcagtggcgctatctcagcttactgcaaactctgcctcccaggttcaagcgattctcctgcctcagcctcccaagtagctgggattataggcgtgcaccaccatgcccagctaatttttgtatttttagtagagatgaggtttcaccatcttggccagactggtctcaagctcctgacctcaagtgatccacccgccttggcctcccaaagtgctggcattacaggcgtgagccaccatgcccagcctaaacatcagagagattattatgtagttatggagacaggtgctgtgaaccccaggcttggggttcagtggaggcctctctttggaagtaacatatcagttgagacttaaaagttgagtggaaattagctggtagaacatggtttctggcagaagagagagtgtatgtagtcctgtaagagaaaaggaacttgggatgttggaaaggtagaaaaaggctggtgtgtctggagagaggctagtgagactgacagggccttggggttctagaaaagaatctgagtttgatccacagggctgtgagaagcc

SEQ ID NO: 2062 - DNA, 700 bp, Homo sapiens
aaaagttgagtggaaattagctggtagaacatggtttctggcagaagagagagtgtatgtagtcctgtaagagaaaaggaacttgggatgttggaaaggtagaaaaaggctggtgtgtctggagagaggctagtgagactgacagggccttggggttctagaaaagaatctgagtttgatccacagggctgtgagaagccatcagagcttttgtcttattcatttaccatatgtctgtcaagtacccttcagtgagtctggtatgtgtcctgtggaaatattttttacctccaatttttattaaattatggacaaaaaaagtaagagagccagatgggaaagaagtagtgctttggccatgagtcaaggcatgctctgtgggcatgagtacagccttgctagtgtggaacttgtgttcaatgtagtttaaggccttaccataggagaaagcagggcctctagagacacagtgccccacccttccactcagttggccccaggaagggtggctactctgggaaggtgaaggtctgactagagcagcaaactactagagccagagaaacagagctgcagtggggactgcacatggtgttggaaacagtacagagctcctggtcagggcactttgcagagtacagtggcttaggcaaggccaaggctagatggggattcaaagggtggggtcagaacaggcatt

SEQ ID NO: 2063 - DNA, 700 bp, Homo sapiens
gaagggtggctactctgggaaggtgaaggtctgactagagcagcaaactactagagccagagaaacagagctgcagtggggactgcacatggtgttggaaacagtacagagctcctggtcagggcactttgcagagtacagtggcttaggcaaggccaaggctagatggggattcaaagggtggggtcagaacaggcattttctgagtacagactcagattattttcatccagggacagcccggatgtgggtctcctgtgggcctcaactcttgaacactcatgacatggagactgttctaatgaatcacactggttaagtaggcatgggaagagcctttcttggctaaagggctggccatggagcagacaccaagtagtgtcactcatgctgagaggagggcaatctatataccttgtcatgtcctttgtggctcaattgctctgagagccttgggtaggagggtcaagctctatgtcttatatttccagatgagtgatgtagaagctggtggtgccaccgtcttccctgatctgggggctgcaatttggcctaagaaggtaagttctgattcttgtgggtcagaggttgaagcaaggctcagactttactttgtccatgtcccccagtaccattacctggcctgcctgattgtcactgtgatgtgccttagcccacctggggtctgacctggtagccc

SEQ ID NO: 2064 - DNA, 700 bp, Homo sapiens
gtagaagctggtggtgccaccgtcttccctgatctgggggctgcaatttggcctaagaaggtaagttctgattcttgtgggtcagaggttgaagcaaggctcagactttactttgtccatgtcccccagtaccattacctggcctgcctgattgtcactgtgatgtgccttagcccacctggggtctgacctggtagcccagcttctccctgtgaagaaaggacagggagggaagtcccttcaggggtgggtgagttcccagacttctacctcagaaaggtaggtgctttctgggaaatgtctctgttgctggagtcccagagccctatcccctgtccatgggaaaatgagggtgtttctgctcagggcagagcttctgtgatgcttgcagtcaggtccctgagcacagtctcttaagaatgtgttctgaaaggccatctctttcccagggtacagctgtgttctggtacaacctcttgcggagcggggaaggtgactaccgaacaagacatgctgcctgccctgtgcttgtgggctgcaagtggggtgagtgtcttaaggggtagtgttggtgttggtggcctcagcttgggctttgcttattggccttagattctgagctgggaggcaactgctgccaaatttgctgagactgtctcccttcttaggtttttttctgctgttattaccatccagccat

SEQ ID NO: 2065 - DNA, 700 bp, Homo sapiens
cgaacaagacatgctgcctgccctgtgcttgtgggctgcaagtggggtgagtgtcttaaggggtagtgttggtgttggtggcctcagcttgggctttgcttattggccttagattctgagctgggaggcaactgctgccaaatttgctgagactgtctcccttcttaggtttttttctgctgttattaccatccagccatgtaatgtccatgcagctggtaaatgccaaggcagctggttggaaacactcagagatacacaggaagctgaagaaggcctgaggacgaatagctgcataagcaccataggtccaggaccctctggcaaggcttctgagggagcagagtggagagctggaagcagtgaggggaaagagtgtctcaggcaaacaaggcccatatggatggaggcacaggctaaaaccagcatacgggtgtgggggctggctcccttgtcacttgaagaaagggaggcctgtggcacaggggccagaagatgaggctggaggctgggaccaaactgcagaggctcaagcttgagccttatcctgggagcagttgtggtgagcctcggagaggctcaaaccaggatatgacaggaagtgtttgtaaggagatgagtgtgtagcccccttggagagttttgaagataaatagtgataggtttgcagataattaagcaaatggaaaagaaaacaagg

SEQ ID NO: 2066 - DNA, 700 bp, Homo sapiens
gctggaggctgggaccaaactgcagaggctcaagcttgagccttatcctgggagcagttgtggtgagcctcggagaggctcaaaccaggatatgacaggaagtgtttgtaaggagatgagtgtgtagcccccttggagagttttgaagataaatagtgataggtttgcagataattaagcaaatggaaaagaaaacaaggcagttgctgaattcaggggaaaaaaagttgtacaagaaaggaaatgtaagtataatctactagatggctcaggtgtaacacatgatataattatgtacacactgagtattactttaactaaaacttatgatttacctgtactggaaaggtgggaggggatgagtttgtgttttaggggtagaataaaagaattccaaagttgaaagtcaaggaatagaactataagcatcttatctagaaaaatgaggttaaatatcagaagaaacagctagaggagtttaatgttccctgggagtggagattagggatgggaaggagaggcttaggaggagtgctatttatcattataagccttgcgacaattttatttttttcaatgaagtacatgttattactttatattttaaaagctctgtgacttcagtagtgcattgaaataaaatttttattcattatgagagagtctgtgaggaacagaatcatggttcctgtgtgtttga

SEQ ID NO: 2067 - DNA, 700 bp, Homo sapiens
attagggatgggaaggagaggcttaggaggagtgctatttatcattataagccttgcgacaattttatttttttcaatgaagtacatgttattactttatattttaaaagctctgtgacttcagtagtgcattgaaataaaatttttattcattatgagagagtctgtgaggaacagaatcatggttcctgtgtgtttgaagatatggcgtggggtgatagtgctggcagcagctctgttgctcttgtgcccatggcatacagactggatctgctggtccacggctcctgaggttaatgtccaagccctctgcaatgctgacagtcttcctcatcctcacaccctacctctcagtttctacctgccacctcccagtaatattaggcctcttgagtccccaacacacgtcagggtggcttctgccttgattactttctcatcctgttgtcactcctgggaccctcttggtgagagaaccatctgggtatgcccatcttcttcccaggataacttctatgtagctttatattctagccctaggatttcctcttccctctaagagcaagaaacatgtgtgcaggttgccatgggaatagagccaaagggcatcaaaggtcatgggcatgaaagggcatgattagatgcccttgggtgctattcccatggcaacctgcacacatgtatcttgtcccactggcag

SEQ ID NO: 2068 - DNA, 700 bp, Homo sapiens
cccaggataacttctatgtagctttatattctagccctaggatttcctcttccctctaagagcaagaaacatgtgtgcaggttgccatgggaatagagccaaagggcatcaaaggtcatgggcatgaaagggcatgattagatgcccttgggtgctattcccatggcaacctgcacacatgtatcttgtcccactggcagaatttcatacaattatctgtttacatgtgtcttccttaccaattcttcagcaaattgaggcctgagatcatgtcttgtcttatttgtgtctgattccagggcacagtgcagggggtcatcatgaaggagtcattcattcaggctactaaactgaccaataggattgtaacatgcttgctttcttttcacagtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagc

SEQ ID NO: 2069 - DNA, 700 bp, Homo sapiens
catgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtg

SEQ ID NO: 2070 - DNA, 700 bp, Homo sapiens
  misc_feature (1)...(700): n = A,T,C or G
ctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatnagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttcagtctttgtatattgtgaataatgctgtgataaacatttttatacatgattcctggtgcacatataa

SEQ ID NO: 2071 - DNA, 700 bp, Homo sapiens
  misc_feature (1)...(700): n = A,T,C or G
agattcatccgtgttgcttgtgtagctgtaatttgttttaatctttatagtacattcagttttgttaatgcttattgtaggactgtaccataatacaggcagcatgctgctgataaacactggaattgatttcagtctttgtatattgtgaataatgctgtgataaacatttttatacatgattcctggtgcacatataaacacatatttctgtaggatatatatctaggagtggaaatgtggagtcttaatggtgttccaactttactaaataatgtattccaaggtggttatacacattctcaccaggagtaaatgagagttattaccccaatcttttccantatttagtattttcatacttttgaattttagctagcttggtacatgttacggactaaatgtttgtgtccccccaccagattcatatgttgaaatctttttttttttttttttttttgngacggagtctcgctctgtcgcccaggctggagtgcagtggcgngatctcggctcactgcaagctccgcctcccggnttcacgccattctcctgcctcagcctcccaagtagctgggactacaggcgcccgccactacgcccggctaattttttgtatttttagtagagacggggtttcaccgttttagccnggatggtctcgatctcctgacctcgtgatccgcccgcctcggcctcc

SEQ ID NO: 2072 - DNA, 700 bp, Homo sapiens
  misc_feature (1)...(700): n = A,T,C or G
ggcgngatctcggctcactgcaagctccgcctcccggnttcacgccattctcctgcctcagcctcccaagtagctgggactacaggcgcccgccactacgcccggctaattttttgtatttttagtagagacggggtttcaccgttttagccnggatggtctcgatctcctgacctcgtgatccgcccgcctcggcctcccaaagtgctgggattacaggcgtgagccaccgcgcccggcccatatgttgaaatcttaacccccaatgtgatgatattaggatgcggagcccttgggaggtcgtaagcatggagcccacgtgagtgggattagtgcccttatgaagagatcccagccctctttctgccatgcgaacacacagcaagaagatgcctgtctatgaaccagggggcccttaccagaaacaancctactagcatcttgatctcggactttccagttcccataaccatgagaaataaatgtttttaattcaatgtatggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttca

SEQ ID NO: 2073 - DNA, 700 bp, Homo sapiens
  misc_feature (1)...(700): n = A,T,C or G
atggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttcactattttagttctgtcttttgataaacaggagcttttaatttttatgtcaaatctatcaagctttttctttttgatttatgttttttatgtcttatttgagaaatccttctataccccaagatcatgaggatgtttcctgtgttctcttctgaaagctatatagtctttgtcatttaggtttatctttatacgtggtatgaagtgtaaagttctacttttaattttttgcatattttattaggataggatgggctttttctgtagtaataatccntaaatctcaggggcttaatatataaaattgtctcatgcaaaaaaccactgggtctagggcaattgctatctactgccgtctaatctccctctagtggcttccattggtagaccctaacaggaagccagctgataagggaatctgggaaatgtagtttacagagtggcagctacagtagaacagtagagactacaaggatgagcttgcagctgagaatagaaacgt

SEQ ID NO: 2074 - DNA, 700 bp, Homo sapiens
  misc_feature (1)...(700): n = A,T,C or G
aattgtctcatgcaaaaaaccactgggtctagggcaattgctatctactgccgtctaatctccctctagtggcttccattggtagaccctaacaggaagccagctgataagggaatctgggaaatgtagtttacagagtggcagctacagtagaacagtagagactacaaggatgagcttgcagctgagaatagaaacgtgactggcacactaggtggtttgtttgtaggttttttcttttcctgtttgagacttttttggattcttgaatttgtacaatgntntccttaatcaattgtggaaaattaaatgattttttctttcagcattgtctgtttcttctgtaactgattaaatgtaagttggatcatatcatgatattatctcttaatctgtctttcatatttttatatatatgctatatttggggagaactttatagctgttttgtacaaagttcactaattctgtcttctatcaagtgcatacaggagtctgtttaaggactttaaagatgtaattctttgttttctggcttataccatttctgttgaaaagtcgctatctggtcctttgttgttcctttgaaggtgattttgccttcacctggctgctttaaagatttttttctttttggttttcagtagttttactatggtgtacttagtatgggtttctttttcttttcttgcttggcatt

SEQ ID NO: 2075 - DNA, 700 bp, Homo sapiens
  misc_feature (1)...(700): n = A,T,C or G
taaggactttaaagatgtaattctttgttttctggcttataccatttctgttgaaaagtcgctatctggtcctttgttgttcctttgaaggtgattttgccttcacctggctgctttaaagatttttttctttttggttttcagtagttttactatggtgtacttagtatgggtttctttttcttttcttgcttggcatttagcttcttgaatttctgggttgatgtctgatcaattttggaaatttctcagacattatatcttcaactattgtttctgtcccattttttctctatctgctctgagacttcagtaatctgaatgttagaacttttcatagtgctctatatatctccagttcttgtgtctctcatgcttttttctttgtgtttcagactagatattttatactgatctgtcttgcaattcatttattacttttgctgctaaacccatctactgagttcttaatttcatttttcttatatttctcagttctaaaatatccattcatgtctttttttttttttttttnccttgagacggagtctttctctgtcacccaggctcgagtgcagtggcgggatctcagctcactgcaccctctgtctcccagattaaagcaattttcccacctcagcctcccaagtagttgggattagaggcacgcaccaccacacccagctaatttttgtatttt

SEQ ID NO: 2076 - DNA, 700 bp, Homo sapiens
  misc_feature (1)...(700): n = A,T,C or G
aaatatccattcatgtctttttttttttttttttnccttgagacggagtctttctctgtcacccaggctcgagtgcagtggcgggatctcagctcactgcaccctctgtctcccagattaaagcaattttcccacctcagcctcccaagtagttgggattagaggcacgcaccaccacacccagctaatttttgtatttttagtagagatggggttttgtcatgttggccaggctggtcgcaaactcctgacctcaagtgatccacctgcctcagcctcccaaaatgttgggattacaggcgtgagccaccacggttggcccattcatgtccttttaatggattttaactctctggagaatctgtcttctgttttctctgtgtttttctcggactgataaatcagttatgtgaatttttttgtccgataacgccatgatttcgattttctatggctctctttctattgtctttttccctccttagtttctggtcatttggtccactctgttgatatgcctggcaatttttgattgaatgtgtatgacaaattgtagagcctctggatggataacctcctgcacaaagggctcaccctttcctctactatgcagagtggggatcaatcaccttaatccagtaaggatctgagctgacttaaaattaagactgggtggtagttttcttaagactctatctct

SEQ ID NO: 2077 - DNA, 700 bp, Homo sapiens
  misc_feature (1)...(700): n = A,T,C or G
tccactctgttgatatgcctggcaatttttgattgaatgtgtatgacaaattgtagagcctctggatggataacctcctgcacaaagggctcaccctttcctctactatgcagagtggggatcaatcaccttaatccagtaaggatctgagctgacttaaaattaagactgggtggtagttttcttaagactctatctctggtttacccttatttccccccttataggatgtagtcctccaggattttctaattgagagcctagtgtgttcactggatctgtttccactggcagttcctcaactctaattcttgtcttctcagtaccagactcagcccaaaaaatttatcctccttttcaaagaatttgaatttttgaatctaagcagatattttttgcttaccttcttagccttgcattctgcacagcgtcagaattcagaaaatgcctcagtgggtaaacaggctgagtggccaagttctccactcctccctcttattcaatattctgagaaactactggctaattttggtttttcaatgccccttgacactgtcaannnnnnnnnnnnnnnnnnnnnnnnntnnnanntnnncattgctctggatcctcattcttaccccatggctacaatcagtaaataataataataataataatnattattattattattatnattattattattttgaggtgg

SEQ ID NO: 2078 - DNA, 700 bp, Homo sapiens
  misc_feature (1)...(700): n = A,T,C or G
caatattctgagaaactactggctaattttggtttttcaatgccccttgacactgtcaannnnnnnnnnnnnnnnnnnnnnnnntnnnanntnnncattgctctggatcctcattcttaccccatggctacaatcagtaaataataataataataataatnattattattattattatnattattattattttgaggtggagtctggctctgtcacccaggttggagtacagtggtgcaatctcggctcactgcaagctccgcctcccgggttcacgccattctcctgcctcagcctcccgagtagccgggactacaggtgcccaccaccacgcccggctaattttttgtattttttagtagagatgggggttcactgtgttaggatggtctcaatctcctgacctcgtgatctgtccgcctcggcctcccaaagtgctgggattataggcatgagccaccacgcccggccagtaaattgtttaaggataaaagagactacagacttttggctcacccacaagatttatccttcttcaggatcttgatgctcaaactctttttgcttcagcaattgactgatgtcttccaacaattttaagagattttattcagctttattctaggaatgaaaattggtctaccataagctactctatcttggaagtagaagtggcctattcattttttaaaaaatcatt

SEQ ID NO: 2079 - DNA, 700 bp, Homo sapiens
  misc_feature (1)...(700): n = A,T,C or G
cagacttttggctcacccacaagatttatccttcttcaggatcttgatgctcaaactctttttgcttcagcaattgactgatgtcttccaacaattttaagagattttattcagctttattctaggaatgaaaattggtctaccataagctactctatcttggaagtagaagtggcctattcattttttaaaaaatcatttttcctatactgatacagaaaaccttatctttcatatcttcttttgttacctagtataacaagacgcttcacactcatcttgagcatttctgacattaagcatggaatcagccgttaaagaatcttattatatgttgatgtctgcctatcaatcccagcatggtcctgggaacaagcatgagataacttctgtcttagagccagggcactgctttcagcaatccttattaattgagcttggcattaatatgttcactagggcagtaaagagttattgagcgtttcattatgcatttggtactgtgctagggatgttacagtctattactgcattcagcaactcttcagaacgaatacataagaagcagaacgtcagaaaggttaggtaatatacctgaggtcacatgaagtctcattgctggtaagtggaggacctgggaatgaaactntggcagcttccaaaagcctttgctctaaaacaaaatttatattttcatgca

SEQ ID NO: 2080 - DNA, 700 bp, Homo sapiens
  misc_feature (1)...(700): n = A,T,C or G
ctgtgctagggatgttacagtctattactgcattcagcaactcttcagaacgaatacataagaagcagaacgtcagaaaggttaggtaatatacctgaggtcacatgaagtctcattgctggtaagtggaggacctgggaatgaaactntggcagcttccaaaagcctttgctctaaaacaaaatttatattttcatgcatttaacagttattaaagatttgatggggaaacataaagactgtctttatctttaaagaattctgagcaatggaagggactcataaataggtgtgtgaaatgtgagaagtctggtaacagagaatgtgcttgaggagcacagtagagtgaaggtctactttaaccaagaagttggcactacagtaggcaccgttggagctgggtcttgaagtatgagcaggaatttgtttactgtgctatcctagtttaaaatacatgcacgtggcttaaaaaataagggacaaaggaaattaccctaaatagttgctgtcccaccttactgccaactcctagtcccccttcctagaggaaccttttcaaattattttaaatttttctgcctattaaatgcttataaaatgctgttccttgatttttccacttcagaaatttgagagatgatcatttagtttatattcactatctcccatggtacctccccctgcctttgccattttttga

SEQ ID NO: 2081 - DNA, 700 bp, Homo sapiens
agttgctgtcccaccttactgccaactcctagtcccccttcctagaggaaccttttcaaattattttaaatttttctgcctattaaatgcttataaaatgctgttccttgatttttccacttcagaaatttgagagatgatcatttagtttatattcactatctcccatggtacctccccctgcctttgccattttttgatagttatattttgtatagtcctctcttgtttgcctggcaacataaatttttttgtttggttaaaactaagatggtgagatgaagatctaaactagaattttaccaaacaaatgatcactattgtctagccaagttgacacatagaattaagtatcatatacccttttgtctcccaactgccggtcagttatgctttggacattattttagtagccatagtaagttgcttctaaaagtgaaaaacacaaatgttatgtttcttaatttcgttgaattagtcactataatgttgatgtagctaatcataaaaaggaatttgtgtcttatttgtctaatagaattcaaaatgaatttataatgtatataatttgatagggctacaataacaaaataccacacactgggtggatcaaacaaaaggaatttgttttcttactgttccagaggctagaagtctaggatcaaggtgtcaacaggttgtgtttcttctgaggcctcac

SEQ ID NO: 2082 - DNA, 700 bp, Homo sapiens
aatcataaaaaggaatttgtgtcttatttgtctaatagaattcaaaatgaatttataatgtatataatttgatagggctacaataacaaaataccacacactgggtggatcaaacaaaaggaatttgttttcttactgttccagaggctagaagtctaggatcaaggtgtcaacaggttgtgtttcttctgaggcctcactgcctggcttggtctgtgtgttgtctatgtcacctcttggtctatgtgttgtctatgtcatatcggattaaagcctgcacatatgaactcattttactttaattatgtctttaatgccctgttgccaaatacagtcacatattgggttaggactttagcatatgaattttgggagaacacataaaactactaggaaatcatgttagatctgatatactattgagactaaagcaaaatacttttccttactctttgtacatcagatatagcccatcatgaacaaatgtatctgattattaagtatgtttgcataagaataatgtcataacactagaagttttttattttgagaaaagagatataggctcttatgaaattattaataaattgaaaaaagatattgacataaaatatctttgaggccatggatataattggacaaatacagcaggtgtgtatataagggtggaaaagccattattttcccccaaaatggttat

SEQ ID NO: 2083 - DNA, 700 bp, Homo sapiens
  misc_feature (1)...(700): n = A,T,C or G
gtatgtttgcataagaataatgtcataacactagaagttttttattttgagaaaagagatataggctcttatgaaattattaataaattgaaaaaagatattgacataaaatatctttgaggccatggatataattggacaaatacagcaggtgtgtatataagggtggaaaagccattattttcccccaaaatggttatgccaaataagttcataatctgtgcaaaaatgctgcttctatgaattaaaatataacctttttagtgtgtacaaatgatacataatcttttatgaattcattgagcagtggaatgttatgcttgttctaaaaactacattaaaaacaaatcctgagaggcatcaaagtcaaatatgatcaaggtactttacacaaagatgtttgtcaaatattaaaagaacataaaatgacaaaatacaatatcctgaaataggaaccatctttgtgtgaacagattacaaattttcatgtaacttgtctatgtggcatggcattttgaactaaatatagtagaaaaaggtttatgaaaaaaaagactatatacaaagctgcatgcttaagaaaaggcctattcgtttgcttataacaaatgagngnaagtaacttaangttatgtttcgttaatgtaanactttaaangngntataantntacttnangnnaaatcagaaatatacaaat

SEQ ID NO: 2084 - DNA, 700 bp, Homo sapiens
  misc_feature (1)...(700): n = A,T,C or G
tgtggcatggcattttgaactaaatatagtagaaaaaggtttatgaaaaaaaagactatatacaaagctgcatgcttaagaaaaggcctattcgtttgcttataacaaatgagngnaagtaacttaangttatgtttcgttaatgtaanactttaaangngntataantntacttnangnnaaatcagaaatatacaaattactgaatgagtatatcaattattgtgggaaaagtgttcgtcgaatagaaattaaagagattacagatgtcctagagatggagatatgaaaaatcaaatgaagtatttttgtatttttacttggagaaattttctacgaatacatctgattaacaaaaagcagccatggccttgacttacctcttaaatagtccaatgatttatatcctgtggcaatttcatctgaaatagtggtaaatagcatgcaatatcaatagtttgcatgaacaaatgtgaccctgaaagagccagtccttcaagatggatcttaagtggctgagtgggcctaaatttaaagcagagccaagaagccatttggtgactagaggccacacacctattttgagttccctgaaaacccacacctctttaactttggaactttcagagctcacctgaaccagccaatcagagcccacctcccttgctgctcagttgtatcaaccaatcagaactgtgtt

SEQ ID NO: 2085 - DNA, 700 bp, Homo sapiens
atggatcttaagtggctgagtgggcctaaatttaaagcagagccaagaagccatttggtgactagaggccacacacctattttgagttccctgaaaacccacacctctttaactttggaactttcagagctcacctgaaccagccaatcagagcccacctcccttgctgctcagttgtatcaaccaatcagaactgtgtttccatctcatttgtatcagtgcacctgattgggaaccagggcaggaacttttgctataaagctagaacccttcctttgttctttggaccgcaccttccttttacattgaaggctgtgttggactccctagtttgcaaactattcactggaataaagtctctttcttccagggaacttttgttcacatttgtaatataaaatcatgatgtttgtatcctctaaaacggatttgcaaatttttcttcgggcagccttacccaaatttcaaaatggtcctgataatttttttaaaacaataccagtcacagtgtgatatagtttggatctgtgtccccaccaaatctcatgtcaaattgtaatcttcagtgttggtcatgggcctggtagtcggtgattagatcatataatggaggcggtccttcatgaatggtttagcaccattcccttggtgctgttctcttgatagtgagttattgtgagatccggttgtttaaaagtgt

SEQ ID NO: 2086 - DNA, 700 bp, Homo sapiens
  misc_feature (1)...(700): n = A,T,C or G
agtcacagtgtgatatagtttggatctgtgtccccaccaaatctcatgtcaaattgtaatcttcagtgttggtcatgggcctggtagtcggtgattagatcatataatggaggcggtccttcatgaatggtttagcaccattcccttggtgctgttctcttgatagtgagttattgtgagatccggttgtttaaaagtgtgtatacactttgggaggctgaggcgggcggattgctttgagctcaggagttcaagaccagcctaggcaatatggtgaaacctcatccctacaaaaactacaaaaattaactgggcatagtggctcactcctgtagtcccagctactcaggaggctgaggttggagaattgcctgagcccgggaagtggaggctgcagtgagccaagactgtgtcactgcacaccagcctgggtgacagagacctgtctcaaaaagaaaatgtagcacctcctctctctctctctctctgtctctctcactgtctcgttctcttgctcttgctccttctccagccatgtaagatgtgcttgcttcccctttgcctttagccatgattcatagtttcctgaggcctctccagaaatggaagccactacacttnctgtacagcctgtagaaccatgagccaataaacctcttttctttataaattacccattttcaggtatttctttatggca

SEQ ID NO: 2087 - DNA, 700 bp, Homo sapiens
  misc_feature (1)...(700): n = A,T,C or G
gtctcgttctcttgctcttgctccttctccagccatgtaagatgtgcttgcttcccctttgcctttagccatgattcatagtttcctgaggcctctccagaaatggaagccactacacttnctgtacagcctgtagaaccatgagccaataaacctcttttctttataaattacccattttcaggtatttctttatggcaatgcaagaacagaccaatgcaccatggtatcctgcaaaatcctgaagttaattaagaattatttaagaggcgcggtggctcacgcctgtaatcccagcactttgggagggtgaggtgggnggatcaggaggtcaggagattgagaccatcctggctaacgcggtgaaaccccgtctctactgaaaatacaaaaaattagccgggcgtagtggcgggcgcctgtagtcccagctgcttgggaggctgaggcaggagaatggcgtgaacccgggaggtggagcttgcagtgagccgagattgcgccactgcactccagcctgggcgacagagcgagactccgtctaaaaaaaagaacattatttaagatcgtcacttaagaagagtagattttgacaattttattgatcagtttacttccattaaagtcattggtataaaatatttaaacttaatatgagttttaatataccaactttcaatattgtcaaccaatttaatgt

SEQ ID NO: 2088 - DNA, 700 bp, Homo sapiens
  misc_feature (1)...(700): n = A,T,C or G
cgccactgcactccagcctgggcgacagagcgagactccgtctaaaaaaaagaacattatttaagatcgtcacttaagaagagtagattttgacaattttattgatcagtttacttccattaaagtcattggtataaaatatttaaacttaatatgagttttaatataccaactttcaatattgtcaaccaatttaatgtgtaaaaattaacaaaaacacgaaaacgtacgtaagaagcatacgtttttcattttgcctcaggcttcaatatagtttggcacagcactgctcttaagtttccaaacttggcattttgnctccaatattagatttgccagattcagcaaatgaaaatacaagtaacacccagtttaactttagataaataacacataatttttgcataggatatatgcatactaaaaagtttgttgcttatctgaaatttaactgggcattttgtataatatctggtaattctaaaaataattatcttacatggttgaaaaagctgcctgcttcttagtacaatgtaactgttgcaccaacaccgtcttgcctgtttgattgctggttatgtggatgactgaagcgcanacangggaagtcatatggnttntgtgtcacantgtccagcntgtaggtatgtccagtccttaccaggtntagaagaacacagcagcctcactccatccgagg

SEQ ID NO: 2089 - DNA, 700 bp, Homo sapiens
  misc_feature (1)...(700): n = A,T,C or G
tggttgaaaaagctgcctgcttcttagtacaatgtaactgttgcaccaacaccgtcttgcctgtttgattgctggttatgtggatgactgaagcgcanacangggaagtcatatggnttntgtgtcacantgtccagcntgtaggtatgtccagtccttaccaggtntagaagaacacagcagcctcactccatccgagggcagaggagcgagcatattccccantgccatgaccctctccccagctccntctgnttcagtcacactgacggccccagtacattcgtgnttgttggtccttctgcctggaaggtaccaatacctagtagtttntaccctcattcctttcaagactgatcaaagattaccttatccaaaagagttcttcttgtttcactgctgtgctgctcgggctagtctggaattcctggcctcaagcaatcttcccaagaggttcctcccttcctccctccctccctccctcccttccttccctttctttcgacagtcttgctttgttgcccaggctggagtgcaggggcgcagtctcggctcactgcagcccactccaagaggccttcatgactactacgaaggatttgcgttctcattctcttcctccttagcctgttttctttcttttttctttttctttttctttttttttctttttgagatggagtcttgctttgtagcccag

SEQ ID NO: 2090 - DNA, 700 bp, Homo sapiens
ttcgacagtcttgctttgttgcccaggctggagtgcaggggcgcagtctcggctcactgcagcccactccaagaggccttcatgactactacgaaggatttgcgttctcattctcttcctccttagcctgttttctttcttttttctttttctttttctttttttttctttttgagatggagtcttgctttgtagcccaggctggagtgcaatggtgcgatctctgctcactgcaaccttcgtcccctgggttcaagcgattctcctgccttagcctcccgagtagcttggattacaggtatgcaccaccacgcccgactaatttttgtatttttagtagagacagcgttccaccatgttggccaggctgctttccgatccctgacctcaagttatcctcccgcctctgcctcccaaagtgctgggattacaggcgtgagctaccacgcccagccctgttttatttttctttagagcacttatcactgaggtaaaaggtgggacttgactccagacgcaggcgtcggacaccggaccagattgaggactggctaaaacagggccagggccaaagtagctttcaatcagcccaccagggtgctacgtcggtttgcagttgctatgacaacaccctggcgttagggcccctttccatggtaatgacccaatgaccccaaagttactactccttctctggaag

SEQ ID NO: 2091 - DNA, 700 bp, Homo sapiens
ggacttgactccagacgcaggcgtcggacaccggaccagattgaggactggctaaaacagggccagggccaaagtagctttcaatcagcccaccagggtgctacgtcggtttgcagttgctatgacaacaccctggcgttagggcccctttccatggtaatgacccaatgaccccaaagttactactccttctctggaagtgtctgcataaacctccccttaatctacatgtaattaaaagtagtaataaacatgactgcaaaactgccctgagctgctacccactgtcaatggggtagccctgctctgcctcttcaagaaagctgttttcttctacctctggcttgccgttgaattctttcctgggcaaagccaagaactctcgtgggctaagctccactttggggctcacctgccccacatcactaccacccgttaagagatttaatttgggtatcagttcgtggtctgtctcccccatggtatagaaggtccttgaaggaaagaactttgcttttccacttctctatccccagtgcccagaatgggcctttggaaagcatcgagcagcctctcttgctcagtgggcactgaaatggcactcggagctcagtacccagataaaggacaccccccagataaaggacaccaccccttcccccgcgcaggcctcgggaaagggcgaggccgtgcgaggcca

SEQ ID NO: 2092 - DNA, 700 bp, Homo sapiens
ggaaagaactttgcttttccacttctctatccccagtgcccagaatgggcctttggaaagcatcgagcagcctctcttgctcagtgggcactgaaatggcactcggagctcagtacccagataaaggacaccccccagataaaggacaccaccccttcccccgcgcaggcctcgggaaagggcgaggccgtgcgaggccacaggaaggggcgtggcctctgaggacctgggggcggggtctggcagggtcagaggtttctggaaaggcctttgacctgtgggcgtgttcctagaggtcaggtggtgagaatggcggggtcagcggacagcagtggggctacaggctgtgtctgtggctgccctggcttagggctctggctggcccctcctttccgacctggtctggcagagcagccccgcaggaccagctcgcaaggctcctggggccagtggggctctgtcctgtgaggcggtccctccgcaaggacagagtcagagagaggctggtgagtcaaggatgtgctctgagcgggggtctgggtgcgtcaaatgatgtcttggacgtaatatctaaggctgacgctactttgaagaggtttaacttttgtgaagattctttattctaaactcgggggaaactttttttttttgatctgcagtcaaatgctctaccactgagctataccccttctgccaactt

SEQ ID NO: 2093 - DNA, 700 bp, Homo sapiens
aggctggtgagtcaaggatgtgctctgagcgggggtctgggtgcgtcaaatgatgtcttggacgtaatatctaaggctgacgctactttgaagaggtttaacttttgtgaagattctttattctaaactcgggggaaactttttttttttgatctgcagtcaaatgctctaccactgagctataccccttctgccaactttttttttttgtaaagcatttgggggttgtgagaagataagtggtaggaaaggccatgggtatttggcaagctcaaagttttttgtttttaaggcacttttcagtgtctttctgaaagtgcgtttataacatggaggatcagccccctccccacaccccagcttggtcctcccttctcttactcttctctgaaaagtccatctctttctcttgaaatttgcagccaacggagcctcactaaagtaatgacccaaactgcttttgtacccagtgggctcacagctgtcatcttgcctgcttctttgatttcaagaagcttaaggcaagctgcttatgctagatttactgtcctcaccttccattcttaaatttttgacgcagtgagtctcccccaactaattctctggaattgtctggtaaagtgttctgggtcctcctagtggccaaacccagtagacacttcggacagttttttttttttcctctagcgaagcacttcgt

SEQ ID NO: 2094 - DNA, 700 bp, Homo sapiens
  misc_feature (1)...(700): n = A,T,C or G
tttgatttcaagaagcttaaggcaagctgcttatgctagatttactgtcctcaccttccattcttaaatttttgacgcagtgagtctcccccaactaattctctggaattgtctggtaaagtgttctgggtcctcctagtggccaaacccagtagacacttcggacagttttttttttttcctctagcgaagcacttcgtgattcaagttctcctttatttccggcctccctggctccttttcatcagcctaggcttctcatatatatgttccctagtctagtttgtttccttttcacggtagtactgtatgctataggaggaaggatctttacttccactgctttaacatgtatatgtttatgatttattgaattgtctttttgtactcaaatctttctcttgagctctgttttagacccttatatccancnttctagaggacatacccacctggaccaacatctagaataggtgtcagaaattattcaacaaatgatcacaaatagggcctgatgtaggaaaaatacaattacaatgactgttaaccttttggggtgacagaccctcttgagacccatatgaaatttcagggtctttatccctttaaaaagtgcacacaaaattttgcctgtttcaaagcttcctagaccttctgtagttcaagaatttgaggctttggttagagcttcctgatatga

SEQ ID NO: 2095 - DNA, 700 bp, Homo sapiens
  misc_feature (1)...(700): n = A,T,C or G
acaaatagggcctgatgtaggaaaaatacaattacaatgactgttaaccttttggggtgacagaccctcttgagacccatatgaaatttcagggtctttatccctttaaaaagtgcacacaaaattttgcctgtttcaaagcttcctagaccttctgtagttcaagaatttgaggctttggttagagcttcctgatatgataatgataaaatgaaaaagtgtgttttcacagataagcatcagatttngaaacttacaatgggaatgcattgtattccagccgtcatcaaacgttaaccctgattaatcacatcaggctgatttatggaaacattgtctttagcagtagcaacatagaatgaaaaatctggagccctagagttgaaatataccccagcagactccctgtggctaaaatgagacataccaaaaccagaatctaacggccacagcaagatgagggcttggtcatgtatccctgtgttactaactaccataaggttttctttcctgtaagcagaaaccaggtcctgaaaaacatcacagaaactacagctggaaatttcctgttgaccctgatagactactacttgacaccagccgaccgatctgctggctgcccaccatggtcctgccacaattctgatgggacagagaattggccttactttctttcctgataaatagccatagacctcaa

SEQ ID NO: 2096 - DNA, 700 bp, Homo sapiens
gttttctttcctgtaagcagaaaccaggtcctgaaaaacatcacagaaactacagctggaaatttcctgttgaccctgatagactactacttgacaccagccgaccgatctgctggctgcccaccatggtcctgccacaattctgatgggacagagaattggccttactttctttcctgataaatagccatagacctcaagccagccagttttggccagcttatagagactgtacacaaactgtctttgtgccctgtagttcacctttttgatgcaaagagccaaattcaccttactttaatgctaaaaccccaccccaaagtgaacatggaatgcatgttacatatatgtttacccactgcacacatgcttgacttccctcatgaatattcacagattcctttaagcctgctaaatataacccagctaatttttatatttttggtacagatagggtttcatcatgttggtcaggctggtcttgagctcctgacctcaagtgatccacccgcctcggcctcccaaagtgctgggattacaggcgtgagccaccgcgcccagcctcatgatgatttctaaacacagattcccctgatccatgtgggcgtgtgtgtatggcggcggcaattttaggagtcaactataacaaggtcccaaggaagtgagaggggagccaagctccaggggacagaagagggaa

SEQ ID NO: 2097 - DNA, 700 bp, Homo sapiens
tgatccacccgcctcggcctcccaaagtgctgggattacaggcgtgagccaccgcgcccagcctcatgatgatttctaaacacagattcccctgatccatgtgggcgtgtgtgtatggcggcggcaattttaggagtcaactataacaaggtcccaaggaagtgagaggggagccaagctccaggggacagaagagggaagggaagggcaatggtgagtttcttttttagggcccatggtgtatgcaggaaacacttcctccccattttgtactttggtgtgtaatgaaatagccaagcaacacttttctctttttctgaacttgctgaggaaaaaggaaaaaagggatccaaatctatctgtcttggagcaaagatgacagaattgcaggcagtgacatgatcaaatgtgctgaggacaggagcaaaccacgcacaccctggagtatccctgtaaggcataaataccagcttcctattcccttttggagtatgtccttttggttttcctgggaggttgcattccccaatttgtagattgtttctccctctgaaaatagttttttttcccttttcttcctctgtgcatctcatggtcttttgttaacatttcaaagagagtttctgattaactgtgggttgcatgtttcacagtccaaatagccttagcctggtcagagaccagggcctgcttcagataa

SEQ ID NO: 2098 - DNA, 700 bp, Homo sapiens
  misc_feature (1)...(700): n = A,T,C or G
tggttttcctgggaggttgcattccccaatttgtagattgtttctccctctgaaaatagttttttttcccttttcttcctctgtgcatctcatggtcttttgttaacatttcaaagagagtttctgattaactgtgggttgcatgtttcacagtccaaatagccttagcctggtcagagaccagggcctgcttcagataatttacgaagttgttgctattaagagtgtaacctggctgggtgcagtagctcacgcctgtaatcctagtactttgggaggccgaggtgggtggatcacttgaggccaggagtttgagaccaacctgaccaacatggtgaaatcccgtctctactaaaaatacaaaaaaattagccaggcgtggtggcacacttctgtgattccagtgacttgagaggctgaggcaggagaattgcttgaacctaggagtnggaggttgcagtgagccaaggttgcgctactgcactccagcctgggcgacagagtgagactctcttgggggaaaaaaaagagtgtaatctgctcccctccagctggacgggaatacagataaggttttgaggcctggtgccttgtaggagccctgagtgatcaggcagtcgtagaagtgcatgaggtgccaggggtttccttccagcagaacttgccttctttatttgttgggccagtgacttctcagttc

SEQ ID NO: 2099 - DNA, 700 bp, Homo sapiens
gagtgagactctcttgggggaaaaaaaagagtgtaatctgctcccctccagctggacgggaatacagataaggttttgaggcctggtgccttgtaggagccctgagtgatcaggcagtcgtagaagtgcatgaggtgccaggggtttccttccagcagaacttgccttctttatttgttgggccagtgacttctcagttccagagttattgccttgatggtccatgagtgctgttttgagattgacccccactctctcttgaatgaaatatatttcatctcttttcttcttgtattgatatgttaatatttattttttaataaaggtgagatctaaggagacattatccactttgtttaaacccttctcttggctgccatgatccaactatcttctggtttttcttctatctctgcctacaacttctcaataccgtagtctcctgtggccctcctttcccaatcctcagttatggctcagagtttctttatagccattttttttttctctgaaggctcatgacttccaaatacttgatattccaaatacttgatatcagtatattgatattgataactcttgagtctttaattctagcttttattactttccaacttccagctccagctctacttagatggcccgcaagttcttccattttaatagatccctaaccaggttcattatacttcccttaaat

SEQ ID NO: 2100 - DNA, 700 bp, Homo sapiens
ttttttctctgaaggctcatgacttccaaatacttgatattccaaatacttgatatcagtatattgatattgataactcttgagtctttaattctagcttttattactttccaacttccagctccagctctacttagatggcccgcaagttcttccattttaatagatccctaaccaggttcattatacttcccttaaatggttcctatttctgttttacttatctttgcaaatggcaaaaatgactgatcattctcctagcctcagctaggaggcgattctctcttctttcttcactgttcttgataactattcatgtgaacttcctttttcactttgcttggtatttttcccccactgttccaggaaattggtaactcgtttctattttgctcttaatctttagagcaaccttagagtttaggtatatagttcccattttactcatgagaaaacaggcttacttttaaaattattaattacacaaagaaaatgtacatgcatgttacctctaagcaaatttaggcaaaacagaaatagaataaaatattacagtgccccctccctcccattactctcctatgtctttagcagtggttctcagctggggagattttgtcccctagggcagtggtccccagacattttggcaccagggacagtttcatggaagacaatttttccatggacgggggttggt

SEQ ID NO: 2101 - DNA, 700 bp, Homo sapiens
gcatgttacctctaagcaaatttaggcaaaacagaaatagaataaaatattacagtgccccctccctcccattactctcctatgtctttagcagtggttctcagctggggagattttgtcccctagggcagtggtccccagacattttggcaccagggacagtttcatggaagacaatttttccatggacgggggttggtgggggatgctttcagaatgaaactgttccaccttagatcatcaggcattacactctcataaggagcatgcaacctacatccctcgcatgtgcatgcatagttcacagtggagtttgcgctgctatgagaagttaatgttgcagctgatctgacaggaggcagagttcaggcagtaatgctcactcgcctgctgctcacctgctgtgcagcccggttgctaacaggccactgaccggtactgatttgcagcctgggcattggggacctcttccctaggagatatttgacaaggtctggagacaattttgattgccttgacttaggggatactactggaataaaactacctattgggcactaaaatatatatatataaatatatataatatataaaaatatatataaatatatatgtaatatataaaaatatataaaaatatatataatatataaatatatataaatatatataatatataaaaatatatataaatatatat

SEQ ID NO: 2102 - DNA, 700 bp, Homo sapiens
  misc_feature (1)...(700): n = A,T,C or G
caattttgattgccttgacttaggggatactactggaataaaactacctattgggcactaaaatatatatatataaatatatataatatataaaaatatatataaatatatatgtaatatataaaaatatataaaaatatatataatatataaatatatataaatatatataatatataaaaatatatataaatatatataatatataaaaatatatataaatatataaaatatataaaaatatataaaaatatatataaatatataatatataaaaatatatataaaaatatatataatatatataaatatatataatatataaaaatatataaatatataatatataaatatatacaatatataaatatacaatatataaatatataaatatataatatataatatatattatatataatatatatattatatattatatatattatatattatatataatatataatatatattatatataatatataatttatatttttaaatatatattttaaatatgtttaatatatattatatattttaaatatatataatatatattaatatatattttaaatatataatatatattatttaatatataatatatatttattatattanattatattaaatatatattaattatattaatatatatttaatatattaatatatatttaatatatattaatat

SEQ ID NO: 2103 - DNA, 700 bp, Homo sapiens
  misc_feature (1)...(700): n = A,T,C or G
tttaaatatatattttaaatatgtttaatatatattatatattttaaatatatataatatatattaatatatattttaaatatataatatatattatttaatatataatatatatttattatattanattatattaaatatatattaattatattaatatatatttaatatattaatatatatttaatatatattaatatatattttaaatatatttaatataattaatattaaatatattaaatataaaaatatatttaaatatatattataatatatatataaacaacaccatcacccacagttcccattacctgtttatagtcttgtttccttcctttgttcttaacaccttctaaggtattatatcattaccttattatgtttattgttatggtttggagatattttcaaatttttactctgtatgatatgtatttggcacagtattcaacaaaatactgtatttggaatccaagtgtttattatggctttttaaaaaaaattaatacatagantaaaaataaatacataacgctagccaaataaatatggattttgcactgtaattgtaaaaaaatgtgttttgcactggtaatccaaaggaaacaaaataaaaataaaaaaaataattctcctatcccaaatgtcagtagtgcccaggttgaaaaactgctctggaggtaatctgttatatatc

SEQ ID NO: 2104 - DNA, 700 bp, Homo sapiens
  misc_feature (1)...(700): n = A,T,C or G
aaaaattaatacatagantaaaaataaatacataacgctagccaaataaatatggattttgcactgtaattgtaaaaaaatgtgttttgcactggtaatccaaaggaaacaaaataaaaataaaaaaaataattctcctatcccaaatgtcagtagtgcccaggttgaaaaactgctctggaggtaatctgttatatatcattttccataactacactatccaatactgtaaccactagccacgtgaggctatttacactgaaattaattaaaattaaataaaaattctgttcctcagtgctattaagtacatttttaagtgttcaatggccacacatggctacagaattaaacagcatagattatagaacatttcaatgattgcagtaagatttgttggacagtgctttaggtatatatcacgcaaatagatgttctgttttacataaatagaatcatacatactgttctatagttttgttaatatgtcttgaagatttttccatctaagtatatataactaaaatatgtactaagtacatataactaaatatttaagtttaatggtctgtgatatagttcagttttattaaattcataaatttaatttattacagcaatgtagtttaattttgcctttttttaagtttatgtgtatggactcatataatacatattatttttatccagtttattttac

SEQ ID NO: 2105 - DNA, 700 bp, Homo sapiens
ttccatctaagtatatataactaaaatatgtactaagtacatataactaaatatttaagtttaatggtctgtgatatagttcagttttattaaattcataaatttaatttattacagcaatgtagtttaattttgcctttttttaagtttatgtgtatggactcatataatacatattatttttatccagtttattttactcaatgctatgtttttaagatatatccatgttatttctgtatatctatagttattccttttaagtgctttatggtattccattggatgaccataccataggttgtttatccatttgacttttgtgggcatttgagtttcttccagtttggggatataatgaataattctggcatgaatattctgtacttatttcctgaaagtatatttttatgcaggttatacatgggaatggaattattggtccactgaaatttactagattatgccactttcttaaaatagttgcattcttcttcttattattatttttgagatggagccttgctctgtcgcctaggctggagtgcagtggtgtgatctcagctcactgcaactttcatctcctgggttcaagcgattctcctgcctcagcctcctgagtacatgggattacaggtatgtgctatcatgcccagctaatttttgtatctttggtagagatggggtttcaccatgttcc

SEQ ID NO: 2106 - DNA, 700 bp, Homo sapiens
ttattatttttgagatggagccttgctctgtcgcctaggctggagtgcagtggtgtgatctcagctcactgcaactttcatctcctgggttcaagcgattctcctgcctcagcctcctgagtacatgggattacaggtatgtgctatcatgcccagctaatttttgtatctttggtagagatggggtttcaccatgttccaggctagtcttgaactcctgacctcaagtgatctgcccgcctcggcctcccaaagtgttgggattacagacgagagccacgttgcctggccgcatttttttcttaatagcagtatgtgagagttcccctctaaactgcatcctaagcagtatctttgtatttgtcagacttttaaagttcaaacttcctggtggcatgtggttgtatcccatagttttattttgcacttctttgattatgaatgatacagaacactttcatatatttatcagtcttttgaatattttcttttatgagttctttttgagtctctagaccatttatctattgagttgttttattaatttgtagaaagactttgtatattctggatacaagccttttattggttgtatatgttgtgtagatattctccacctttagtggctgcttgccttttctgtctctcttaatggtgatttttgatttgttttgagaaatatcaacctttcttcttaaga

SEQ ID NO: 2107 - DNA, 700 bp, Homo sapiens
  misc_feature (1)...(700): n = A,T,C or G
tttttgagtctctagaccatttatctattgagttgttttattaatttgtagaaagactttgtatattctggatacaagccttttattggttgtatatgttgtgtagatattctccacctttagtggctgcttgccttttctgtctctcttaatggtgatttttgatttgttttgagaaatatcaacctttcttcttaagattattcaataacagcaaagtaacaatgagaaactactgtcagtttaagtgggtttagctcctcagttccaaggtatataatcacttaaatataacctggaaaaaaaaacaaaaatatttctctaaatcatggtctttgtaaaaaaatgaattaaatcttctctgttctctcatattgtattccaattntggatgtagccaccagtgagatagcaaatgtctaaatttggatacatcacttaaatatttagaacgtcattggtttcttcaaacagtggaaaattcttgccatgcctaccttatagactttgtataatgctattatcaatgctagctgatactaacttagaagatgattatacatttttaaacagctcttcctatcctggttctacaataagacactgactccaccacatactggatgacctagagcaagttaacttaatgacactgtgcattaatttactttgctataacaatgggataatatatcaattc

SEQ ID NO: 2108 - DNA, 700 bp, Homo sapiens
  misc_feature (1)...(700): n = A,T,C or G
atagactttgtataatgctattatcaatgctagctgatactaacttagaagatgattatacatttttaaacagctcttcctatcctggttctacaataagacactgactccaccacatactggatgacctagagcaagttaacttaatgacactgtgcattaatttactttgctataacaatgggataatatatcaattcatgttattattgcagctattgttcagatagaacaattgagagaatttataaacaaaatgactaagcagatgagttagttttcctaattggccagcttaagggagagagttataagggctatagagttctagatgaaattataacatcacctcaaagagagagcaacttacctctggtcaggctttcttcctgaagtgtttcttgggagagggtgagcagagtggtcaagagcctatctatttatttcagtgggctaagcatagatgtccttgagangaagacttccttggtcctttaggtaatgtaagtccttcaacttcattctttttcaaaattgttctgactattctgggtcccttttatttccatgtgaattttaggatcagcttgtcaatttctncaacaagcccagctaagattttgataggttttaccttgttcttgctcttaggagccaagcagcccatctttcaccattaagtatgatgttagttgtgaga

SEQ ID NO: 2109 - DNA, 700 bp, Homo sapiens
  misc_feature (1)...(700): n = A,T,C or G
aatgtaagtccttcaacttcattctttttcaaaattgttctgactattctgggtcccttttatttccatgtgaattttaggatcagcttgtcaatttctncaacaagcccagctaagattttgataggttttaccttgttcttgctcttaggagccaagcagcccatctttcaccattaagtatgatgttagttgtgagagtttcgtatctgtctttatcacattaagaatgttctcttctattcctagtctgtggagaggttttttgtttgtttgtttgtttgtttgtttgtttttttagacagagtctcactctgtcatccaggctggagtgcagtacaatctctgctctctgctctctgcaacctccacctcccgggctcaagtgattctcctgcctcagtctcctgagtagctgggattacaggtgtgcgccaccacatccagctaatttttgtatttttagtagagacggggttttaccgtgctggccaggctggtttcaaattcctgacctcaggtgatccacccgcgttggcctcccaaagtgctgaggttacaggtctgaaccatcatgcccagcctagatttttttttaaaaatcataaataggtgttgaattttgtcaaatgcctttcctgcgtctgtggaaataatcatgtgtcctttattctatatagtctcttacattaattgcatg

SEQ ID NO: 2110 - DNA, 700 bp, Homo sapiens
  misc_feature (1)...(700): n = A,T,C or G
tttcaaattcctgacctcaggtgatccacccgcgttggcctcccaaagtgctgaggttacaggtctgaaccatcatgcccagcctagatttttttttaaaaatcataaataggtgttgaattttgtcaaatgcctttcctgcgtctgtggaaataatcatgtgtcctttattctatatagtctcttacattaattgcatgttaaaccaacctcatattcttgcagaaatctcacttggtcatggtgtatacattctttttacatattcctggatttagtttgctaataattaaggattctcatgatgatgttcatgagggttttgtagttttctttttgtatgatgtctttagctttgggattagggtaataaacatcttagatttagttgggatctgttctcttctctattttctgaagactttgtgaaggattagcattattttttggttaaatatttgataaaattcaccagtgaagttatctgggcctagaattctctttatgggaagattttacatttctaattcagtttctttactttttataggcctatttagattgttctgtatattttttagttcattttggtaatttgtacctttntaggaacttttccacttcatattagttgcctgctttgttggcataaagatgtttacagcatttccttgtaatttctataggatncagtagtcta

SEQ ID NO: 2111 - DNA, 700 bp, Homo sapiens
  misc_feature (1)...(700): n = A,T,C or G
ctttatgggaagattttacatttctaattcagtttctttactttttataggcctatttagattgttctgtatattttttagttcattttggtaatttgtacctttntaggaacttttccacttcatattagttgcctgctttgttggcataaagatgtttacagcatttccttgtaatttctataggatncagtagtctattctttctttcgtccctttattgggtaatttttatcttctctatttttttcttggtcagtctaaaggtttgtcaattttgttgatcttttcaaataatcagcctttaggtttctttggttttctctatttttccattttctattttgttgatttctgctcttatccttattatttcatttattttgcttgctttgatcattttaacttgcccctccttttttagtttcttaaggtgagagcctgggttattgattagagacttttttttaaatataggcatttaaagctatacattttcttctaagtaccacttgaaactgcatcccataaattttaatatattgtagttttgtttttatttagttcaaaatatattttagttttcatngtgaattcttctttgacctatgggttatttagaagaatgttgttcaatttccaaatatttgaagatattcaagatttctttctattttttatgtttaattccatgtggttg

SEQ ID NO: 2112 - DNA, 700 bp, Homo sapiens
  misc_feature (1)...(700): n = A,T,C or G
tctaagtaccacttgaaactgcatcccataaattttaatatattgtagttttgtttttatttagttcaaaatatattttagttttcatngtgaattcttctttgacctatgggttatttagaagaatgttgttcaatttccaaatatttgaagatattcaagatttctttctattttttatgtttaattccatgtggttggacagcatattctgtatgagttaaatctttaaaatttatcaggacttggtttgtgacctaacatatggtctttcctggaggatgtctgtgtgagcttgaaaggaatgtgtattctgctgttttttgatggagaattctataggtgtcaggtgaaattggttgatagcattgttcagatcttgtatatccttcctgattttctgtgtggttgttttaccagttcataagagtgaggtattcaaaatatccagctattattgaattacctatttcttctttcagcactgtcaattgttgttttatgtctttcggggctttcattaagtgatatacatctataattattacatctttttgatatattgactcttgttacattataaaatgtttccttttgtctctagcagtatttcttattctaaagtttattttgtcagatattaatacagccaccccatctctcttgtagttgttgtttgcatggtacatcttttacctct

SEQ ID NO: 2113 - DNA, 700 bp, Homo sapiens
tatgtctttcggggctttcattaagtgatatacatctataattattacatctttttgatatattgactcttgttacattataaaatgtttccttttgtctctagcagtatttcttattctaaagtttattttgtcagatattaatacagccaccccatctctcttgtagttgttgtttgcatggtacatcttttacctctttttttttttttaagacagggtctcaccctgttgccaggctggagtgcagtggcgtcatctcagctcacccaaacctctgcctcccgggttcaagtggctctcctgcctcagcctcccaagtagctgagattacaggcacataccaccacgcccagataatttttgtatttttagtagatatgaggtctcaccatgttggccaggctggtctcaaactcctggcctcaagtgatccacccaccttggcctcccaaagtgctgggattacaggtgtgaaccactgcgcctggcttacctttttttttttttttaaccttaaaaacctttttagattatttgaatctaaagtgtgtctttgtatgtagcatgtatttggatcttgttttatttattcaatctgaaaagctctgagtttgctaagaaaaatcaaggtggttcagtggtagagaatctcagagcagaagggtttcagatagattgtttagggatgatctctttg

SEQ ID NO: 2114 - DNA, 700 bp, Homo sapiens
ttttttttttttaaccttaaaaacctttttagattatttgaatctaaagtgtgtctttgtatgtagcatgtatttggatcttgttttatttattcaatctgaaaagctctgagtttgctaagaaaaatcaaggtggttcagtggtagagaatctcagagcagaagggtttcagatagattgtttagggatgatctctttgtagtggtgacataaagctgatactaaagactagaaggaatcaaagtgtgaagaagggaagggaaaggaaagagcattataaatcaagagaacagaccctgagtgataggagagcttgacatttttgaagaactgaaagagaagctggttcatagtgagcaaagggaatgtggtggcagatgaagggtagtatgctaaacaagggtgacactgcggaatcttgaagtctatggtgaaaagtttgtattttattgaaaaagtagtgtgaagtcattgaaatttttgaagagtagaagaaacttgatccaatttgtgtgtacaaaatctgaatctaaaccttggtaagcaagaaatagcatattgtaggctgggcatggtggctcacgcctgtaatcccagctctttgggatgccgaggcgggtggatcgcctgaggtcgggatttcgagaccagcctggccagcatggtgaaaccccgtctctactaaaaatacgaaaacta

SEQ ID NO: 2115 - DNA, 700 bp, Homo sapiens
  misc_feature (1)...(700): n = A,T,C or G
tgatccaatttgtgtgtacaaaatctgaatctaaaccttggtaagcaagaaatagcatattgtaggctgggcatggtggctcacgcctgtaatcccagctctttgggatgccgaggcgggtggatcgcctgaggtcgggatttcgagaccagcctggccagcatggtgaaaccccgtctctactaaaaatacgaaaactagctggggatggtggcaggtgcctgtaatcccagctactctggaagctgaagcaggagaatcacctgaacccaggaggtggaggtttcagtgagccgagattgcgccattgcactccagcctgggtaacagagtaagactccatctcaaaaaaaaaaaaaaaaaaaaaaaaaaaaaaaaangaangcangaaatagcgtattgtaatttttttcctaattcaaattaaatttgacttanatactcttccctgatgagctggtgagaaatgtattgtcagtcactattagggctgtgtcacctcagaagttcccaccaaactaacaaggttgctagaaaatagaaggaaaacttctaactttgagtttgtcatggtcattgggctagtatgtggatgtttgtccatatccacagtttccttaaaggatggtagttttctgcttctatgccactttggggttcatgaaactggagatgacaagtcctggtactctttttggtg

SEQ ID NO: 2116 - DNA, 700 bp, Homo sapiens
tcagaagttcccaccaaactaacaaggttgctagaaaatagaaggaaaacttctaactttgagtttgtcatggtcattgggctagtatgtggatgtttgtccatatccacagtttccttaaaggatggtagttttctgcttctatgccactttggggttcatgaaactggagatgacaagtcctggtactctttttggtgtaccatggaaccatcattttttaggtctaattctttcttagagatgctgcctgtgagtgtggtagtcagttctctttattatactttttcttttttcctccctcttctgacctttccttttgttttcagaaattactctagaatgtatactcttctcttgttaccattaaaaacttaacaggattttactttgatttttacaaaagacacgaagtgcaattacctggattagcttcttctatgaagaaaaataaagcagcctaacagggtagagattgatagagtctactatcttaaatagagagactaggaaactctctcttagtagagtcatttgagtagaatcctgaaggcagtaaaagaaaataacatttcacgcaaagggaataacaaatacaaggtgtctgggaatggagagtagttggtgtttttgaggaaaagtaaaggtcaggctactgtggctggaacgaatgaacaaggttaaggagctttagtagatg

SEQ ID NO: 2117 - DNA, 700 bp, Homo sapiens
gagagactaggaaactctctcttagtagagtcatttgagtagaatcctgaaggcagtaaaagaaaataacatttcacgcaaagggaataacaaatacaaggtgtctgggaatggagagtagttggtgtttttgaggaaaagtaaaggtcaggctactgtggctggaacgaatgaacaaggttaaggagctttagtagatgaagtagccagatatcagagcatgcagaaccttgaaagtcgggggaaggactttgaggttttactatgagtgagatcatagaagattattttgtagagtagactacagaggggacaagggcatgcaagaaaaaaccagactggacacctagatattgaacttactaaataaagacattaagccaactgttataaatattttcaaagaactaaagacaactatgtctaaagaattaaagtttgagaatgatgtcttacttaatagagaatatcaattaaaagatataagttattttacaaaccagatggatattctggttgacaaatacaataactgaaatgtaaaattcactaaagggactcatcatcctttttgaacttgcaaaataaagaatcagtgaacttaagatcacccagtctgagaaacagaaagaaaaaagaatgcagaaaaatgaacagagccatacagatttgtgagaaaccatcacatgtatcaatacat

SEQ ID NO: 2118 - DNA, 700 bp, Homo sapiens
cagatggatattctggttgacaaatacaataactgaaatgtaaaattcactaaagggactcatcatcctttttgaacttgcaaaataaagaatcagtgaacttaagatcacccagtctgagaaacagaaagaaaaaagaatgcagaaaaatgaacagagccatacagatttgtgagaaaccatcacatgtatcaatacatgcataaggagaatcccaaaagaaaagaaaaagaaagggcagaaagaatatttgaagatatgatggcaagaaactacaaatttgataacaaacactaatctgcacactaagaaactagtgaactccaagtaggataaacctagagacacgtcatagtcaaactattgaaagccaaagatcaagaaagaatcttggccaggcacagtggctcatgcctgtaataccagcactttgggaagctgaggtggacagattacttgagctcacaagtttgagagcagcctgggcaacatggagaaaccctgtctctacaaaaaatacaaaaattagccaggcgtggtgttgcatgcctgtagtcccagctactcgggaggctgagatgggaggaaatagaggttgtggtgagccaagattgtgccactgcacttcaggctgggcaatagaaccagacctctcaaaaagaaagagagaggccgggcgcggtgctcacgcctgtaatcc

SEQ ID NO: 2119 - DNA, 700 bp, Homo sapiens
  misc_feature (1)...(700): n = A,T,C or G
cctgtctctacaaaaaatacaaaaattagccaggcgtggtgttgcatgcctgtagtcccagctactcgggaggctgagatgggaggaaatagaggttgtggtgagccaagattgtgccactgcacttcaggctgggcaatagaaccagacctctcaaaaagaaagagagaggccgggcgcggtgctcacgcctgtaatcccagcactttgggaggctgaggcgggcggatcacgaggtcaggagatcgagaccatcctggctaacacggtgaaccccgtctctactaaaaatacaaaaaattagccggccgtggtagngggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaanaaaaagagagagagagagagagagaatattgaaaatagaaagagaaggcagcaaggcatgttcaataaaattaacagctttcttttcattagaaactgtggataccacagaaggcagagggatgatgtattcaaagtgctgaaagaaaaggactgtcaactaggagttgtatattcagcaaagctagtcttcaaaaattaaggtgaatttaaaacattcccatgtaaacaaaaacag

SEQ ID NO: 2120 - DNA, 700 bp, Homo sapiens
  misc_feature (1)...(700): n = A,T,C or G
gaaagagaaggcagcaaggcatgttcaataaaattaacagctttcttttcattagaaactgtggataccacagaaggcagagggatgatgtattcaaagtgctgaaagaaaaggactgtcaactaggagttgtatattcagcaaagctagtcttcaaaaattaaggtgaatttaaaacattcccatgtaaacaaaaacagaattcttcactagcagacatgccctataagaaatatgaaagggggttctttaggttgaaatgacaggacactaaatagtaacttgaatccacacagagaaataaagagtactggtaaagataactctataggtaaatgtaaaagtcagtataaatattatttttgtttgtaacctttttcttctatctgattcaaaagacaactacataaagcaataattataattatatatttaataatgtgtaaggatattcttttaatgccaataataataaaaggagaggagaaggaatggagctgtacgggaacagggtttttatatattattgaaattacgtcaatattactctgagctagattgctttaagttaagacgttaattgcagtccccagggcaaatactaataaaagaactaaaaaaagtggtaaaatagctaacaagtggattaaaatgntatactagaaaactaacacaaaagaaggcagtaatgaaaggatag

SEQ ID NO: 2121 - DNA, 700 bp, Homo sapiens
  misc_feature (1)...(700): n = A,T,C or G
tacgggaacagggtttttatatattattgaaattacgtcaatattactctgagctagattgctttaagttaagacgttaattgcagtccccagggcaaatactaataaaagaactaaaaaaagtggtaaaatagctaacaagtggattaaaatgntatactagaaaactaacacaaaagaaggcagtaatgaaaggatagaggaacataaaggcatgtacagaaaacagcaaaatggcaaatgtaaatctcatcagtaattccaagaaatgaaatgggcactacagtcaaaaggcatagattaagagaatgaataaaataacataatccaactatatgctatctatgagacaaatatatattcagagaaacaaataggttgaaagtgaaaagatggaagaagatacagaatacaacaattctccaaaaaagaactggagaggctgtgctagtattagacaaaatagactttgagacaaaaattgttactagagaccaagaagaacattttatattaaaaaggtcagtccatcaaaaaaacataacaattataaacatatgcacctaagagcagagcctcaaaataaatgaggcaaaacccagcagaattaaaggaaaatagacaattcaacaataatagttggagatgtcaatacctcactttgaaaaatggatacaacatataggtagatgatcactgg

SEQ ID NO: 2122 - DNA, 700 bp, Homo sapiens
  misc_feature (1)...(700): n = A,T,C or G
agaacattttatattaaaaaggtcagtccatcaaaaaaacataacaattataaacatatgcacctaagagcagagcctcaaaataaatgaggcaaaacccagcagaattaaaggaaaatagacaattcaacaataatagttggagatgtcaatacctcactttgaaaaatggatacaacatataggtagatgatcactggggaactagaagacttcagcaacactataaaccaactagtctaatagacacctntaaaacactctccccaacagtgtaaggcacattcttctcaaatacacatttaaaattcttttctccctttctttctttttttttttttggacaggatattgttctgtggtctaggctggagtgcagtggcatgatcacagctcactacagctgcaaagtcctgggctcaagcagtcttcctgctccagcctcccaaatatctgggactataggtgtgcaccaccatgcttcgctaatatttttgttttagtagagaaagggtctcactatgttgcccagactggtcttgaactcttggcctcaagcagtcctcccacctggcttcccagatagggaattataggcatgagctactgcagccaacctctagacctcatgtcagaccataaaataagtctcaataaacttaaaagaattcaaattatataaagtatgttttaactacaa

SEQ ID NO: 2123 - DNA, 700 bp, Homo sapiens
  misc_feature (1)...(700): n = A,T,C or G
tagtagagaaagggtctcactatgttgcccagactggtcttgaactcttggcctcaagcagtcctcccacctggcttcccagatagggaattataggcatgagctactgcagccaacctctagacctcatgtcagaccataaaataagtctcaataaacttaaaagaattcaaattatataaagtatgttttaactacaacagtagaaattcgaaaccaataacaagaaaatttgggaaattcactaatatgtggaaatttgttaacatactcctacataaccagtaggtcaaataaggaatcacaagagaaattagaaagtattttgagatgagtgtaaatgaaaatacaatataccaaaacttagaggatgtagctaaagcagcgcttagaggaaaatttatggatgtaaacacctgtatttaaaaaggagaaaaatattaaattaaaacataatcttttaccctaggaaatcagaaaagagctaacttgagccaaggcaaacagaaggaaataaagactancacagaaataaattaagtagagaatagaaacacagtaaaaaaaatcagtaaaaccaaaagtggatttaaaaaaaaatcaacaaaatgtacaaacctttggctaggttaaccaataaaaaaatacagaggactcaaataactcaactattagaagaaaatattggactaaatcttcc

SEQ ID NO: 2124 - DNA, 700 bp, Homo sapiens
  misc_feature (1)...(700): n = A,T,C or G
caaacagaaggaaataaagactancacagaaataaattaagtagagaatagaaacacagtaaaaaaaatcagtaaaaccaaaagtggatttaaaaaaaaatcaacaaaatgtacaaacctttggctaggttaaccaataaaaaaatacagaggactcaaataactcaactattagaagaaaatattggactaaatcttcctgaccttacgtaggtaatgatctctcatatattacatcaaaggcatacagaatcaaagaaaaatttgatatattggttttaaatatatattggacttcatcaaaattgtaaaattctgatgttttacaggacgctgttgagaaagtgcagacagactccagaataagtaggtggtggcgggggagggcagcggatatttgcaaatcacatatctgaacttgtatcaagaatatatagagaactgttacaactcaacantaaaaagacaaccctatttatttatttatttatttattttgagacaaagtctcgctcttgtcccccaggctggagtgcagtggcacgatctcagctcactgcaacctccgcctcccaggttcaagcgattctcctgcctcagcctcccaagtagctggtattacaggcgcctgccaccacgcctggctaatttttgtatttttagtagagatggggtttcactatgttggccaggttggtct

SEQ ID NO: 2125 - DNA, 700 bp, Homo sapiens
gacaaagtctcgctcttgtcccccaggctggagtgcagtggcacgatctcagctcactgcaacctccgcctcccaggttcaagcgattctcctgcctcagcctcccaagtagctggtattacaggcgcctgccaccacgcctggctaatttttgtatttttagtagagatggggtttcactatgttggccaggttggtctcgaactcctgacctcaggtgatccacctgcctgggcctcccaaagagctgggattacaggcgtgagccaccatgcctggccaacaactcaatttaaaagtgggcaaagaatttgaatagaaatttcctcagaaaagatatacaaatggccaataaatacatgaaaagatgctcagcatcactaatcattagggaaatgcaaatcaaaaccacagtgagataccacttcctatacagtaggatggctaaaataaaaaaagacagaaaattactagtgttggtgaagatgtggagagattagaaacttcattcattgctggtggggttgtaaaatgatgcagccaccttggaagacagattggcagctcctcatacagttaaacatacagttaccatatgacccaactatttcattcctgggtacatacccaagataaatgaaaatatatatccacacaaaaacttgtacatgaatgtacatagcagaattattcataatta

SEQ ID NO: 2126 - DNA, 700 bp, Homo sapiens
aaacttcattcattgctggtggggttgtaaaatgatgcagccaccttggaagacagattggcagctcctcatacagttaaacatacagttaccatatgacccaactatttcattcctgggtacatacccaagataaatgaaaatatatatccacacaaaaacttgtacatgaatgtacatagcagaattattcataattaaccagagagtagaaacaacccaaatgcccatcaactgaccaataaataaacaaaatgtggtatatccatactatggaatattattcagcaaaataaaaaggaatgaagtgctgatgcatgctgtaatatggatgaaacttagaaaaattatactaagtgaaagaagccagacacaaaaggccacatattgtttaattccatttatatgtaatatctagaatagccaaatgcatagaaatagatattagactagtggttgccaagggatggaaaagggggatcagggagtgattgctgatggatacgggctttctctttgatatgacaaaaatgctctggaattagaggtgatggctgtgtaatttaaaactacgctttactttacatgaattttatggtatgtgaattatcagtaaagctgttaagaaaagtaagttcactcaattttacatttaagacaaaagatccccaattgtggtggatggaagaacatcctcact

SEQ ID NO: 2127 - DNA, 700 bp, Homo sapiens
gatacgggctttctctttgatatgacaaaaatgctctggaattagaggtgatggctgtgtaatttaaaactacgctttactttacatgaattttatggtatgtgaattatcagtaaagctgttaagaaaagtaagttcactcaattttacatttaagacaaaagatccccaattgtggtggatggaagaacatcctcactcttcatcaaggccagtacattaaccaaagaacatttgatgaaggagtccgtcagttcttgaatttcctgatgaagaaacaactggttggctagcaaagaaaagctgtactttagaaatttatctttttgtttcttagatggtctactaaactatgcttcaaacataggattgtagaaatctgaatataatagtaattacaagaaatacaaatgcattgaacttagcaattagaagagacatattcacttaatgttcgacaaatactcagtgtatattatatgccaggctctgctgtaaatacatggggcatcagcaagcaaactagacaagaatttccaccctcatggaactaatgttctagttaagggaaaaagtccaataaaatacactggttaagtatgttttttgtatgttaaaatatattaggtgctatgaataaaatagagtagtgtgagcaaggctgggggtgctgggaagttggaatttaatgttctcagat

SEQ ID NO: 2128 - DNA, 700 bp, Homo sapiens
acatggggcatcagcaagcaaactagacaagaatttccaccctcatggaactaatgttctagttaagggaaaaagtccaataaaatacactggttaagtatgttttttgtatgttaaaatatattaggtgctatgaataaaatagagtagtgtgagcaaggctgggggtgctgggaagttggaatttaatgttctcagattcaataaaaaatttagctatattatgtttacaaaagacacataaaactcgagaatacagaaaggttgagtgtaaaggaattatatatatgctagacaattagaaaaaagtatgctgatatggcaatattagtatcagacaaaatgatctttaaggcaaatgatgttaaggatgctaaacttgcttgggcattataatacagcatataaatattaaaacaaatacaaaattacaaggaagaattgataaagctgtaattattgtgggatattttaatgtacctattcagtaaatagagcaaatcaaaaaataaagcaaataagtaaagcaaatcaaagcacagtaaggttattgataatttgaacaacacatttcacaaggttgatacaatgaacacatagagaaccctgcatgttcatttcaagtgcttatagaatatcttttaaaaattccccacatactaggttataaaacaaacctcaggttcccaaaataaggaac

SEQ ID NO: 2129 - DNA, 700 bp, Homo sapiens
atcaaaaaataaagcaaataagtaaagcaaatcaaagcacagtaaggttattgataatttgaacaacacatttcacaaggttgatacaatgaacacatagagaaccctgcatgttcatttcaagtgcttatagaatatcttttaaaaattccccacatactaggttataaaacaaacctcaggttcccaaaataaggaactgaacagaccatgttctctgataatcattccttgaagtcagaaagtaacaaaagtgacttttaaaagctcatgttttaaaaatttaaatatacagttaaatagctaatgaaaaagttatgatgtcactatagaaattagaaaatattagaatggaatgaatataataaaaatatatatcagatcttgagggatgcatttagattgtcttggagcaatatttacagcccttatttatttatttattttttattattattatactttaagttttagggtacatgtgcacaatgtgcaggttagttacatatgtatacatgtgccatgctggtgcgctgcacccactaactcgtcatctagcattaggtatatctcccagtgctatccctcccccatccccccaccccacaacagtccccagagtgtgatgttccccttcctgtgtccatgtgttgtcattgttcaattcccacctatgagtgagaatatgcggtgtttggtt

SEQ ID NO: 2130 - DNA, 700 bp, Homo sapiens
gttacatatgtatacatgtgccatgctggtgcgctgcacccactaactcgtcatctagcattaggtatatctcccagtgctatccctcccccatccccccaccccacaacagtccccagagtgtgatgttccccttcctgtgtccatgtgttgtcattgttcaattcccacctatgagtgagaatatgcggtgtttggttttttgttcttgcgatagtttactgagaatgatgatttccagtttcatccatgtccctgcaaaggacatgaactcatccttttttatggctgcatagtattccatggtgtatatgtgccacattttcttaatccagtctatcattgttggacatttggcttggttccaagtctttgctattgtgaataatggcgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagttccaccaacagtgtaaaagtgttcctatttctccacattctctccagcacctgttgtttcctgactttttaatgatcgccattctaactggtgtgagatggtatctcattgtggttttgatttgcatttctctgatggccagtgatgg

SEQ ID NO: 2131 - DNA, 700 bp, Homo sapiens
tccctgaggaatcaccacactgacttccacaatggttgaactagtttacagttccaccaacagtgtaaaagtgttcctatttctccacattctctccagcacctgttgtttcctgactttttaatgatcgccattctaactggtgtgagatggtatctcattgtggttttgatttgcatttctctgatggccagtgatggtaagcattttttcatatgttttttggctgcataaatgtcttcttttgagaagtgtctgttcatgtccttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatcagatcccatttgtcaattttggcttttgttgccattgcttttggtgttttagacatgaagtccttgcctatgcctatgtcctgaatggtaatgcctaggttttcttctagggtttttatggttttaggtctaacgtttaagtctttaatccatcttgaattgatttttatataaggtgtaagcaagggatccagtttcagctttctacatatggctagccagttttcccagcaccatttattaaataggga

SEQ ID NO: 2132 - DNA, 700 bp, Homo sapiens
gacatgaagtccttgcctatgcctatgtcctgaatggtaatgcctaggttttcttctagggtttttatggttttaggtctaacgtttaagtctttaatccatcttgaattgatttttatataaggtgtaagcaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcgtgatgcctccagctttgttcttttggcttacgattgacttggcgatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgaggatggaatgtttttccatttgtttgtatcctcttttatttccttgagcagtggtttgtagttctccttgaagaggtccttcacataccttgtaagttggattcctaggtattttattctctttg

SEQ ID NO: 2133 - DNA, 700 bp, Homo sapiens
ggggatggcattgaatctgtaaattaccttgggcagtatggccattttcacgatattgattcttcctacccatgaggatggaatgtttttccatttgtttgtatcctcttttatttccttgagcagtggtttgtagttctccttgaagaggtccttcacataccttgtaagttggattcctaggtattttattctctttgaagcaattgtgaatgggagttcactcatgatttgggtctctgtttgcctgttgttggtgtataagaatgcttgtgatttttgcacattgattttgtatcctgagactttgctgaagttgcctatcagcttaaggagattttgggctgacacaatggggttttctagatatacaatcatgtcatctgcaaacagggacaatttgacttcctcttttcctaattgaataccctttatttccttctcctgcccaattgccctggccagaacttccaacactatgttgaataggagtggtgagagagggcatccctgtcttgtgccagttttcaaagggaatgcttccagtttttttccattcagtatgatattggctgtgggtttgtcatagatagctcttattatttcgaaatacgtcccatggatacctaatttattgagagtttttagcatgaagggttgttgaattttgtcaaaggccttttctgcatctattgagata

SEQ ID NO: 2134 - DNA, 700 bp, Homo sapiens
gagggcatccctgtcttgtgccagttttcaaagggaatgcttccagtttttttccattcagtatgatattggctgtgggtttgtcatagatagctcttattatttcgaaatacgtcccatggatacctaatttattgagagtttttagcatgaagggttgttgaattttgtcaaaggccttttctgcatctattgagataatcatgtggtttttgtcattggttctgtttatatgctggattacatttattgatttgcgtatattgaaccagccttgcatcccagggatgaagcccacttgatcatggtggataagctttttgatgtgctgctggattcggtttgccagtattttattgaagatttttgcatcaatgttcatcaaggatattggtctaaaattctcctttttggttgtgtctctgcccggctttggtatcaggatgattctggtctcataaaatgagttagggaggattccctctttttctattgattggaatagtttcagaaggaatggtaccagttcctccttgtacctctggtagaatttggctgtaaatccatctggtcctggactcttcttggttggtaagctattgattattgccacaatttcagatcctgttattggtctattcagagattcaacttcttcctggtttagtcttgggagagtgtatgtgtcgaggaatttatc

SEQ ID NO: 2135 - DNA, 700 bp, Homo sapiens
aatagtttcagaaggaatggtaccagttcctccttgtacctctggtagaatttggctgtaaatccatctggtcctggactcttcttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgtgtctatttgattcttttctctttttttctttattagtcttgctagcggtctatcaattttgttgatcctttcaaaaaaccagctcctggattcattgattttttgaagggttttttgtgtctctatttccttcagttctgctcttattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcatcccagagattctggtatgttgtgtctttgttctcgttggtttcaaagaacatctttatttctgccttcatttcatcat

SEQ ID NO: 2136 - DNA, 700 bp, Homo sapiens
ttgctcttgcttttctagttcttttaattgtgatgttagggtgtcagttttggatctttcctgctttctcttgtgggcatttagtgctataaatttccctctacacactgctttgaatgcatcccagagattctggtatgttgtgtctttgttctcgttggtttcaaagaacatctttatttctgccttcatttcatcatgtaccagtagtcattcaggagcaggttgttccgtttccatgtagttgagcggttttgagtgacattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtacattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatttata

SEQ ID NO: 2137 - DNA, 700 bp, Homo sapiens
gttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatttatagccttaaatgactaaatttgaaaggaagaaagcctggaattaatgagctaagctttgttaaggtaagtgaaaattctgtattgtattttaaggttcaagtgctgaaatcactttatttttttaattgcaaaattgggtttttcttccatttaacctgttgaacccaaatctgccttattgacctccttgggtctcttctaccccttgaattgttagtgaactccagtgacatatatagtgacaaacaggaagtatgctgaaatctgaggcaataaaataggtttacaacctagtgtaattctagacagaattaatagtggtctggcatttagaatgagaaagtggtggctgtttctcagttggaccagccttccagatatatattaatagctgtacattatcgtttaattcagaagaaagtagcctggatgttaaagggttatgtgaacataatatgaaaaacagcatgtggaatagagacatagagaatgaaaaagaaa

SEQ ID NO: 2138 - DNA, 700 bp, Homo sapiens
ctagacagaattaatagtggtctggcatttagaatgagaaagtggtggctgtttctcagttggaccagccttccagatatatattaatagctgtacattatcgtttaattcagaagaaagtagcctggatgttaaagggttatgtgaacataatatgaaaaacagcatgtggaatagagacatagagaatgaaaaagaaaaaaacttcattggatcataaagcaacaaggctcacaactggagcattctctcttctgagaaatctgctctgacatccttctcctctccccaacctcccaataggtgtatcttccatttgttccatagtagcccgtgattcgctccactacagaagttggttatatttaattttaattgtccatttacatctatattgcttttattaaactgtttccctcagtaagcaaagactgatttttaaatcatttttgcattttcaagcccaactgtggtgctgagtacttaatttgatctgtattgaatgaaattgaagttattgaaggaagaaaggatgaactaatgaattaaagcaattgattatattttttttctctgtggccctgaggattagccctagagcacatatgtagaacatgcagacagatatacttgggttctgtatgaagataaatcttaactgccatgggctggcaagatggccgaataggagcagttctgg

SEQ ID NO: 2139 - DNA, 700 bp, Homo sapiens
gaatgaaattgaagttattgaaggaagaaaggatgaactaatgaattaaagcaattgattatattttttttctctgtggccctgaggattagccctagagcacatatgtagaacatgcagacagatatacttgggttctgtatgaagataaatcttaactgccatgggctggcaagatggccgaataggagcagttctggtctgcagctcccagtgagatcaatgcagaaggcaggtgatttctgcatttccaactgaagtacccagctcatctcaacccatggagggcgacctgaagcagggtgggttgtctcacccaggaagtgcaagggttcggtgaacttttcccatggtctttgcaacccatagaccaggagattccctcgggtacctacaaaccagggccccgggtttcaagcacaaaactgggtgaccatttgggcagacaccgagataactgcaggagttttttttcataccctagtggcacctggaacaccagcaagacagaacggttcactaccctggaaagggggctgaagccagggagccaagtggtctagctcagtggatcccacccccatgaagcccagtaagctaagatccactggcttgaaattcttgctgccagcacagcagtctgaagttgaccaggaatgctcaagcttgggtggggggcggatgggggggtgaggggggt

SEQ ID NO: 2140 - DNA, 700 bp, Homo sapiens
agcaagacagaacggttcactaccctggaaagggggctgaagccagggagccaagtggtctagctcagtggatcccacccccatgaagcccagtaagctaagatccactggcttgaaattcttgctgccagcacagcagtctgaagttgaccaggaatgctcaagcttgggtggggggcggatgggggggtgaggggggtggggcattgccattactgaggcttgagtaggcaggtttcccctcacagtgtaaacaaagctgcctggaagttcaaactgggcggagcccaccacagctccacaaagcctctgtagacagactgcctctctagattcctagtctctggacagggcatctctgaaagaaaggcagcagccccagtcaggggcttatagataaaactcccatctccttgggacagagcacttggggtaaggggcagctgtgggtgcagcttcaacagacttaaacattgctgcctgctggttctgaagagagcagtggatctcccagcacagccatagagctctgctaagggatagactgcatcctcaagtgggtccccaaaccccatgcttcctgactgggagacacctcccagtaagggtcaacagacacctcatacaggggagctccgcctggcctctggcgggtgcccctcagggacgaagcttccagaggaaggaacatgcagcattc

SEQ ID NO: 2141 - DNA, 700 bp, Homo sapiens
agtggatctcccagcacagccatagagctctgctaagggatagactgcatcctcaagtgggtccccaaaccccatgcttcctgactgggagacacctcccagtaagggtcaacagacacctcatacaggggagctccgcctggcctctggcgggtgcccctcagggacgaagcttccagaggaaggaacatgcagcattctctgtagcctctgctggtgatacccaggcaaacagggtctggagtggacttccagcaaactacaacagacctgcagcagagggacctgagtgttagaaggaaaactaacaaacagaaagaaatgacgtcaacatcaacacaaaggacgtccacacagaaaccccatccaaaggtcaccaacatcaaagaccaaggtagataaatccatgaagatgaggaataccagcgcaaaaaggctgaaaattccaaaatccagaatgtctcttctcctccagaggatcacaactcctcaccagcaagggaactaaactggatggagaatgagtttgacaaattgacaaaagtaggcttcagaaggtgggtaataacaaattcctctgagctaaaggagcaagttctaacccaatgcaaagaaactaagaaccttgaaaaaaaggttagaggaattgctaactagaataaccagtttagaaaaaagcataaatgacctgatggagctg

SEQ ID NO: 2142 - DNA, 700 bp, Homo sapiens
ggaactaaactggatggagaatgagtttgacaaattgacaaaagtaggcttcagaaggtgggtaataacaaattcctctgagctaaaggagcaagttctaacccaatgcaaagaaactaagaaccttgaaaaaaaggttagaggaattgctaactagaataaccagtttagaaaaaagcataaatgacctgatggagctgaagaacacagcacaagaacttcacgaagcatacacaatttcaatagctgaatcgatcaagcagaagaaaggatattagagattgaagatcaacttagtgaaataaattgtgaagacaagattagagaaaaaagaatgaaaagaaatgaacaaagcctccaggaaatatggaactatgtgaaaagaccaaacctacgtttgattggtgtatctgaaagtgagggggaaattggaaccaagttggaaaacactcctcaggatattatccaggagaacttccccaacctagcaagacaggtcaacattaaaattcaggaaatacagagaacaccacaaagatactcctcaagaatagcaaccccaagacacataatcatcagattcaccaaagttgaaatgaaggaaaaaatgttaagtgcagccagagagaaaggtcgggttacccacaaagggaagcccatcagactaacagtggatctctgcagaaactctacaagtcag

SEQ ID NO: 2143 - DNA, 700 bp, Homo sapiens
acattaaaattcaggaaatacagagaacaccacaaagatactcctcaagaatagcaaccccaagacacataatcatcagattcaccaaagttgaaatgaaggaaaaaatgttaagtgcagccagagagaaaggtcgggttacccacaaagggaagcccatcagactaacagtggatctctgcagaaactctacaagtcagaagagagtggggccaatattcatcattcttaaagaaaataattttcaagccagaattttatatccagccaaactaagctttataagtgaaggagaaataaaatcctttccagacaagcaaatgctgagagattttgtcaccaccaggcctgccttataagagctcctgaaggaagcactaaatatggaaaggaaaaactggtacaagccactgcaaaaacataccaaattgtaaagaccatcaacactatgaagaaactgcatcaactaatgggcaaaataaccagctagcatcataatgacaggatcaaattcacacataacattattaaccttaaatgtaaatgggctaaatgccccaattaaaagacacagactggcaaattggataaagagtcaagacccatctgtgtgcaatattcaagagacccatctcacgtgaaaagacatacataggctcaaaataaggagatggaagaatatttatcaggcaaatggaaa

SEQ ID NO: 2144 - DNA, 700 bp, Homo sapiens
acaggatcaaattcacacataacattattaaccttaaatgtaaatgggctaaatgccccaattaaaagacacagactggcaaattggataaagagtcaagacccatctgtgtgcaatattcaagagacccatctcacgtgaaaagacatacataggctcaaaataaggagatggaagaatatttatcaggcaaatggaaagcaaaaagaagcaggggttgcagtcctagtctccaataaaagagactttaagccaacacagatcaaaaaagacaaagaggggcattacataacggtaaagggatcaatgcaacaagaagagctaactatcctaaatgtttatgcacccaatacagggcacctagactcataaagcaagttcccagtgacctacaaagagacttagacccccacataataatagtgggaagactttaacaccccactgtcaatattagacagattaatgagacagaaaattaacaagcatattcaggacttgaactcagctctggacaaagtggacctaatagacatctatggaactctccaccccaaatccacagaatatacattcttctcagcaccacgtcacacttattctaaaattgaccacataattggaagtaaaacactcctcagcaaatgcaaaagaacagaaataataacaaacagtttctcagaccacggtacaatcaaat

SEQ ID NO: 2145 - DNA, 700 bp, Homo sapiens
gaactcagctctggacaaagtggacctaatagacatctatggaactctccaccccaaatccacagaatatacattcttctcagcaccacgtcacacttattctaaaattgaccacataattggaagtaaaacactcctcagcaaatgcaaaagaacagaaataataacaaacagtttctcagaccacggtacaatcaaattagaacttaggattaagaaactcacccaaaactgcacaactacatggaaactgaacaacctgctactgaatgactactaggtaaataatgaaattaagagagaaataaattctttgaaaccaatgagaagaaagacacaatgtgccagaatctctgggacacagctaaagtagtgtttagaggaaaatttatagcactaaatgcccacaggagaaagtggaaaagatctaaaattgacaccctaacatcacaatgaaaagaactagagaagcaagagcaaacaaattcaaaagctagcagaagacaagaaataactaagatcagagcagaattgaaggagatacaggcacaaaaaaccctccagaaaatcaaaatcagtgaatccaggagctggttttttgaaaagaataacaaaatagactgctaaccagactgataaagaagaaaagagagaagaattgaatagacacaataaaaaatgataaagggggtattcccac

SEQ ID NO: 2146 - DNA, 700 bp, Homo sapiens
aagacaagaaataactaagatcagagcagaattgaaggagatacaggcacaaaaaaccctccagaaaatcaaaatcagtgaatccaggagctggttttttgaaaagaataacaaaatagactgctaaccagactgataaagaagaaaagagagaagaattgaatagacacaataaaaaatgataaagggggtattcccactgatcccacagaaatacaaactaccttcagagaatactataaacacctctatgaaaataaactagaaaatctagaagaaatggataaattcctggacacatacaccctcccaagactaaaccaggaagaagttgaatctctgaatagaccaatgacaagttctgaaattgaggcagtaattaatagcctgccaaccaaaaaaagcccaggaccagatggattcacagccgaattctaccagaggtacgaagaggagctggtaccattccttctgagactattccaaacaatagaaaaggagggaatcctccctaactcattttatgaggccagcatcatcctgataccaaaacctggcagagacacaacaaaaaatgaaaatttcaggccaatatccctgatgaacattgatgcgaaaaccctcaataaaataatggcaaaccgaatccagcagcacagcaaaaagcttatccaccacaatcaggttggctttatttctg

SEQ ID NO: 2147 - DNA, 700 bp, Homo sapiens
gggaatcctccctaactcattttatgaggccagcatcatcctgataccaaaacctggcagagacacaacaaaaaatgaaaatttcaggccaatatccctgatgaacattgatgcgaaaaccctcaataaaataatggcaaaccgaatccagcagcacagcaaaaagcttatccaccacaatcaggttggctttatttctgggatgcaaggctggttcaatatatgcaaatcaataaacataatccatcacataaacagaaccaatgacaaaaaccacatgattatctcaatagatgcagaaaaggcctttgacaaaattcaacaccccttcatgctaaaagctctcaataaactaggtattgatggaacacatctcaaaataataagagctatttttgacaaacccacagccaatatcatactcaatgggcaaaagctggaagcattccttttgaaaaccgacacaagacaaggatgccctctctcaccactcctattcaacgtagtattggaagttctggccagggcaatcaggcaagaaaaagaaataacgggtattcagataggaaaagaggaagtcaaattgtctctctttgtagatgacatgattgtatatttagaaaaccccatcatctcggctgggcacagtggctcacgcctgtaaccccagcactttgggaggctgaggcgggtggatcac

SEQ ID NO: 2148 - DNA, 700 bp, Homo sapiens
acgtagtattggaagttctggccagggcaatcaggcaagaaaaagaaataacgggtattcagataggaaaagaggaagtcaaattgtctctctttgtagatgacatgattgtatatttagaaaaccccatcatctcggctgggcacagtggctcacgcctgtaaccccagcactttgggaggctgaggcgggtggatcacaaggtcaggagatcgagaccatcctggctaacacagtgaaaccctgtgtctactaaaaatacaaaaaaaaaaaaaaattagccaggtgtggtggtgggcacctgtagtcccagctacatgggaggctgatgcaggagaatggtgaaaacccaggaggtggagcttgcagcgagcctagattgtgccactgcactccagcctgggctacagagagaggctccatctcaaaaaaaaaaaaaacaaaaaccaaaaaaaaaaaaacccatcgtctcagcccaaaatctccttaagctgacaagcaacttcggcaaaggctcaggatacaaaaccaatgtgcaaaaatcacaggcattcctatacaccaataatacacaaacagccaaatcatgcatgaacatccatgcacaattgccacaaagagaataaaatacatgggaataaaatttacaagggatgtgaaggacctcttcaaggagaactacaaaccactgcccaaggaa

SEQ ID NO: 2149 - DNA, 700 bp, Homo sapiens
aacttcggcaaaggctcaggatacaaaaccaatgtgcaaaaatcacaggcattcctatacaccaataatacacaaacagccaaatcatgcatgaacatccatgcacaattgccacaaagagaataaaatacatgggaataaaatttacaagggatgtgaaggacctcttcaaggagaactacaaaccactgcccaaggaaataagagaggacacaaacaaatggaaagacattccatgctcatgaataggaagaatcaatatcgtgaaaatggccatactgcccaaaataatttatagatccagtgctatccccatcaagctaccattgactttcttcacagaattagaaaaaactactttaaatttcatatggaaccaaaaaagaacctgtatagccaagacaatcctaagcaaaaagaacaaagctggaggcatcatggtacctgacttcaaactatactataaggctacagtaagcaaaacagcatggcagtcgtaccaaaacagatatatagaccagtggaatagaacagaggcctcagaaatagcaccacacatctacaaccatctgatctttgacaaacctgacaaaaacaagcaatgggggaaggattccctatttaaaaatggtgttgggaaaactggctaaccatatgcagaaaactgaaactggacctcttctttacaccttatacaaaa

SEQ ID NO: 2150 - DNA, 700 bp, Homo sapiens
caaaacagatatatagaccagtggaatagaacagaggcctcagaaatagcaccacacatctacaaccatctgatctttgacaaacctgacaaaaacaagcaatgggggaaggattccctatttaaaaatggtgttgggaaaactggctaaccatatgcagaaaactgaaactggacctcttctttacaccttatacaaaaattaactcaagatggattacagacttaaatgttagacctaaaaccataaaaaccctagaagaaaacctagacaatgccattcaggacataggcatgggcaaagacttcatgactaaaacaccaaaagcaatggcaacaaaagccaaaatagacaaatgggatctaattaaactaaagagcttctgcacagcaaaagaaactatcatcagagtgaacaggcaacctacagaatgggagaaaatttttgtaatctttccatctgacaaagggctaatatccagaatctacaagggactcaaacaaatttacaagaaaaaaacaaccccatcaaaaagtgggcaaaggatatgaacagatgcttctcaaaggaagacttttatgcagccaacaaatatatgaaaaaaagctcattatcactagtcattagtgaaatgaaaatcaaaaccacaacgagataccatctcatgccagttagaatggcaatcattaaaaagtcagga

SEQ ID NO: 2151 - DNA, 700 bp, Homo sapiens
caaatttacaagaaaaaaacaaccccatcaaaaagtgggcaaaggatatgaacagatgcttctcaaaggaagacttttatgcagccaacaaatatatgaaaaaaagctcattatcactagtcattagtgaaatgaaaatcaaaaccacaacgagataccatctcatgccagttagaatggcaatcattaaaaagtcaggaaacaacagatcctggagaggatgtggagaagtaggaatgcttttacactgttggtgggagtgtaaattagtccaaccattgtggaagacagtgtggtgattcctcaaaaatctagaacctgaactaccatttgacccagcaatcccattactgggtatatacccaaaggattataaatcattctactataaagacacttgcacatgtatctttattgcagcactattcacaataacaaagacttggaaccagcccaaatcaaatgtccatcaatgatagactggataaagaaaatgtggcacatatacaccatggaatactatgcagccataaaaaaggattagttcatgtcctttgctgggacatggatgaagctggaaaccagcattctcagcaaactaacacaggaacagaaaatcgaacaccgcatgttctcactcataagtaggagttgaacaatgagaacacatggacacagggagaggaacttctcacactgg

SEQ ID NO: 2152 - DNA, 700 bp, Homo sapiens
acatatacaccatggaatactatgcagccataaaaaaggattagttcatgtcctttgctgggacatggatgaagctggaaaccagcattctcagcaaactaacacaggaacagaaaatcgaacaccgcatgttctcactcataagtaggagttgaacaatgagaacacatggacacagggagaggaacttctcacactggggccagtcaggggtgggggactaggggagggatagcattaggagaaatacctaaggtagatgttgggttgatgggtgcagcaaaccaccatggcacatatatacctatgtagcaaacctacacattctacacatgtatcccagaacttaaaatatatatatataaatatcttaactgccaaaaagtggaaggaactgcttgacaggtagtacactccatttctatccaaggagatgttctggcataaagtagacaaccaacaaatggggatactacagagtcacctcatttttattgaattcagtaaacttattaacatctgttacatactaggatgctgtactaagcaaaaaagtgaaacatttatggcgtgtgtccagaatatcttatggtctatttggggatggtggtggtagactagatatttaaacagacatcttcagttgattgtgtggcaagtcataaaatggatgttcagagtactgtgagagctcagggaa

SEQ ID NO: 2153 - DNA, 700 bp, Homo sapiens
tcagtaaacttattaacatctgttacatactaggatgctgtactaagcaaaaaagtgaaacatttatggcgtgtgtccagaatatcttatggtctatttggggatggtggtggtagactagatatttaaacagacatcttcagttgattgtgtggcaagtcataaaatggatgttcagagtactgtgagagctcagggaaatgtactcaaatgctggatttataattttataatcactgtagctgaccaaagggcaacttctaatttgactgcaatatgttttcttttagttataccatcataaaaacctgttttagataatcttgggaagattttacactcttctcttttcctttttttttttttttttgagacagtcttgctctgtcaccccggcttgagtgcagtagcatgatttcggctcactgcaacctcctcctcctgggttcaagtgattctcctgccccagcctcctgagtagctgggattacaagcatccgccaccatgccctgctaattttgtatttttagtagggacagggtttcaccatgatggctaggctggtctcgaactcttgatgtcaggtgatctgcctgcctcagcctcccaaaatgctgggattacaggtgtgagccaccatgaccggctgatttcacactcttagactttgctgcgctaactcatgttaggaaaatcttt

SEQ ID NO: 2154 - DNA, 700 bp, Homo sapiens
  misc_feature (1)...(700): n = A,T,C or G
ccaccatgccctgctaattttgtatttttagtagggacagggtttcaccatgatggctaggctggtctcgaactcttgatgtcaggtgatctgcctgcctcagcctcccaaaatgctgggattacaggtgtgagccaccatgaccggctgatttcacactcttagactttgctgcgctaactcatgttaggaaaatctttcttctgttgacactattgccagggtcctgtctttgactttggctagcatgggagaatccttcatgactgctgtaaaaaataagctttgtaaattccttcaattatttggtaagagccttggactaggagttagacgtctaggctccaattctgatctgcccctctttttctatatgaccttgacctaagttccttgattactttgggaatcagttttcttatctgaagaatgggaaaccaaaacattggctggacttttctcttgggtattgtgaaggcagatgagatgatgatacctgtcgaaattatcagggaaggtataagttatctgggactctagtgtacattttaactatggtcagcggtgtaaaacataacattgtcatgaaaacatgttaggaagcagatgtgatcgcatgaatgtgaattgtgagtgagaggtaggacaactgtctntctgtctgtgctagagaccttgggactagtgggtgatgaaaggt

SEQ ID NO: 2155 - DNA, 700 bp, Homo sapiens
  misc_feature (1)...(700): n = A,T,C or G
cgaaattatcagggaaggtataagttatctgggactctagtgtacattttaactatggtcagcggtgtaaaacataacattgtcatgaaaacatgttaggaagcagatgtgatcgcatgaatgtgaattgtgagtgagaggtaggacaactgtctntctgtctgtgctagagaccttgggactagtgggtgatgaaaggtgggatgggttttctccaccctaatctttatttctctttcgattctaattctggacagtgttcaaattctacacggtttngtgacagtagtttgaaaaagggatttgtagagcttctctaagcgacctccctgattgctagccatttcctaccctctcttctttccaatgtccagactcctctcacaaacaagcctagttgaatctgccaactttaagaagttgttagaggaagaaagggcaggaaagcttggatacaaggcatcaaagaccaagaaggagacattgagtagtgtccttgaggactctctggaccgtctggaaaactgggaggtctatgagggcctctgctgtggagagggtatcaaactcattgctgtgctctaaatgtttgtgtccccctggaattcatatgtcaaaatcataacctgcaaggtgatagtattagaaggtgaggtcttttgggaggcgattagtgcccttgtcaaagagacccaagaga

SEQ ID NO: 2156 - DNA, 700 bp, Homo sapiens
ggactctctggaccgtctggaaaactgggaggtctatgagggcctctgctgtggagagggtatcaaactcattgctgtgctctaaatgtttgtgtccccctggaattcatatgtcaaaatcataacctgcaaggtgatagtattagaaggtgaggtcttttgggaggcgattagtgcccttgtcaaagagacccaagagagcttcctgacccctcccactatgtgagaacacagctagaaggctccatatgtgaaccagaaagcaggctcttaccagacagtgaatctgctgggtgccttcatcttggacttcgagcctccaaaactgtgaaaaataaatttctcttgtttataagtcactcagtcaaaggtattttgttagagcagcccggctagacaaagacacctgtaaaaatgggaaaggaggtggatggggttgaaagggctgcttagggtccttgagagaccttcagatcccctgataatatgaatgcttgggaccttggctttgaagggccagatttggttgagaaagtattccagtcctcaaacctggcccttaaatgcacctctgggtctctctcagtgttacagttatattgaacacttatttttattgatggctaattaggtgctaggcattaagaccattatttatattactttttgataattttttattaaatggctatagaaaaaa

SEQ ID NO: 2157 - DNA, 700 bp, Homo sapiens
ccttggctttgaagggccagatttggttgagaaagtattccagtcctcaaacctggcccttaaatgcacctctgggtctctctcagtgttacagttatattgaacacttatttttattgatggctaattaggtgctaggcattaagaccattatttatattactttttgataattttttattaaatggctatagaaaaaaattaagtattttctcagtctttcatcatatctgaattattgcactcactttgattaattcatgggacattttcttaatagtttgttagtttattgcctttggaaagttcctttttcctgtattttggcatgattagcattaatgttttgtactcacttgtttctggttcagtactagtgatacatgtggaaaaatgaattaatatatgccccttctttggtagagtgtagtctattaaaggaaaatttaaaatgtaaatcagtgattttaatatggtagtggtatgtgcaaagtctggtggcaacacagaagacgcaattaactctgctttaggacagagaggattgagagttcacaaggaaaggactcttgaattagaatttcatgtagacagtggtagtaagagaagttttaggctgatgctgtttcatgtgcaaatatacagtaaaaaaattacactgtattttgagaacagcaataattttttctattagaagaac

SEQ ID NO: 2158 - DNA, 700 bp, Homo sapiens
gcaacacagaagacgcaattaactctgctttaggacagagaggattgagagttcacaaggaaaggactcttgaattagaatttcatgtagacagtggtagtaagagaagttttaggctgatgctgtttcatgtgcaaatatacagtaaaaaaattacactgtattttgagaacagcaataattttttctattagaagaacataaaatttgaaaaaggaaactatggtgttcaagatgttaatatatgcaggcttgtattatggagggtcaggtggatcatgacatagaacttggattttgctttgttaggcagttctcaaacttaattgtgcataggaatcacctgaaaatcttggaaaagtacagatcttgattcagtaagttagagtacagcctgagagtctgtatttctaacaatctccctgctacactgggagtagcaaggatgtacagaatagaaagcactgtaaggttcaatcaggggagtgagccagttaccttggacatgatagaaagatgactggaagagaaacgctgtttctttccagccccatagaaattgaattgttaccgttgtacaagtcctgtgtaagggtggcttccctcatagagcttgcagatgtgaggaggaatgttcctgagagataagaagctgttgaatggtttatgtttgtcatttgtgccaaccaagaaaaggact

SEQ ID NO: 2159 - DNA, 700 bp, Homo sapiens
tggacatgatagaaagatgactggaagagaaacgctgtttctttccagccccatagaaattgaattgttaccgttgtacaagtcctgtgtaagggtggcttccctcatagagcttgcagatgtgaggaggaatgttcctgagagataagaagctgttgaatggtttatgtttgtcatttgtgccaaccaagaaaaggacttttgtttcagttctgaggggtgaaggaggtgggcataaggagtggggctagtgcctacagccagaggagactggtacttaagcgagagcctgttgctctgtgctccccaggcaccacagaagcagcagaggcttttctgtaggtactaccatggcaagagggctccacagcttctcatcactcacttggaagaggatgatgagtgggacatcatcaggtattataatgtcatgtctgaggaggaaatcaaaaggatgaaggagattgtgaagcccaaagtaagtttctcagttggttctcaccacattttccctctgccacttcctgagacctaccttgctgtcattattttagagaaacttaaggaaaaagctggtagcagagttgcaagcagatttattttttaatgacctggtcctccagaagaaataaatatcattatgtattatttggtacctcagatgagaattttaaaaatctctttaaattttattaatttt

SEQ ID NO: 2160 - DNA, 700 bp, Homo sapiens
accacattttccctctgccacttcctgagacctaccttgctgtcattattttagagaaacttaaggaaaaagctggtagcagagttgcaagcagatttattttttaatgacctggtcctccagaagaaataaatatcattatgtattatttggtacctcagatgagaattttaaaaatctctttaaattttattaattttcaacattttatcttagttttaaagattgcatatggctttttagggtttgttgcctttttctttttaattgacataattgtatatatttatggggtacagtgtgatattttgatatgtatatacaatgtgtaatgattaaatcacggtaattagcatatctatcacctcaaacatttatctgtgtgtgtgtgaacattcaaaatcttctcttctagatatgtgaaaataaaaaattaattgttaattatatttaccctacagtgctatagaacactagagcttattcctcctatctagcttttacatttgtatctattaaccaacctttggctatcccaccctttctcttatacttccctgcctctagtaaccactattctattctcttctatgaaatcaattttttttagcttcaatatgtaagtgagaccatgtgctatttatctttctctgcctggcttaatttcccttaacataatgtcctccaggctcatccatgt

SEQ ID NO: 2161 - DNA, 700 bp, Homo sapiens
ttacatttgtatctattaaccaacctttggctatcccaccctttctcttatacttccctgcctctagtaaccactattctattctcttctatgaaatcaattttttttagcttcaatatgtaagtgagaccatgtgctatttatctttctctgcctggcttaatttcccttaacataatgtcctccaggctcatccatgttgctgtaaatgagagaatttcattctttttgtggttaaataatatttcatatatatataccagattctctttatccattcatgttaatggacacttacgttgattccataccttggctattgtgaagagtgctacaataaacatgggattgcagatatttctttgacatactaatttccttccctttggatatgtacctagcggtaggattgctggaacataaagtagttctattttagtttttttgagaacctccataatgttttctataatggctttattaatttacattcctaccaacagtgtataagagttcacttttctccacagccttgccagcatttgttattttttgtcttttttaaaataggtgtgagaaaatatcttattgtggttttggtttgcatttgcctgatgattagtgatgttgagcattttttcatatacctgttggccatttctatgtcttcttttaagatgtctgttcagcttatttgctt

SEQ ID NO: 2162 - DNA, 700 bp, Homo sapiens
cagtgtataagagttcacttttctccacagccttgccagcatttgttattttttgtcttttttaaaataggtgtgagaaaatatcttattgtggttttggtttgcatttgcctgatgattagtgatgttgagcattttttcatatacctgttggccatttctatgtcttcttttaagatgtctgttcagcttatttgcttattttttaatcggattattattattttttgctattgagttgtttgagttctttgcatattctggctatcaattccttgtcagatgaatagtttgcaaatatttcctcccattctgcaggttgtctcttcactctgttgattgtttcctttgctgtggagaaggtttttttgtttgatataatctcatttgtttatttttgcttttgttgcctgtgcacaaaagagatccttgccataaaaatctttgcccaaaggatatgaacagacacttctcaaaagaagacatttatgcagccaacagacatatgaaaaaatactcatcatcactggtcatcagagaaatacaaatcaaaatcacagtgagataccatctcacgccagttagaatggcaatcattaaaatgtcaggaaacaacagatgctggagaggatgtggagaaataggaacgcttttacactgttggtgggagtgtatattagtccaaccattgtggaagaga

SEQ ID NO: 2163 - DNA, 700 bp, Homo sapiens
gacatatgaaaaaatactcatcatcactggtcatcagagaaatacaaatcaaaatcacagtgagataccatctcacgccagttagaatggcaatcattaaaatgtcaggaaacaacagatgctggagaggatgtggagaaataggaacgcttttacactgttggtgggagtgtatattagtccaaccattgtggaagagagtgtggcgattcctcaaggatctagaagaaataccatttgacccagccatcccattacttgggtatatacccaaaggactataaatcatgctactataaagacacatgcacacatatgtttattgcggcgctattcacaatagcaaagacttggaactaacccaaatgtccatcaatgatagactggattaagaaaatgtggcacatatacaccatggaatactatgcagccataaaaaagggatgagttcatgtcctttgtagggacatggatgaagctggaaaccatcattctcagcaaactatcgcaaggacagaaaatcaaacactgcatgttctcactcataggtgggagttgaacaatgagaacacatagacacagggagaggaacatcacactctggggcctatcatggggtggggggctgggggagggatagcattagtaggagaaatacctaatgtaaatgatgagttgatgggtgcagcaaacaaacatg

SEQ ID NO: 2164 - DNA, 700 bp, Homo sapiens
aactatcgcaaggacagaaaatcaaacactgcatgttctcactcataggtgggagttgaacaatgagaacacatagacacagggagaggaacatcacactctggggcctatcatggggtggggggctgggggagggatagcattagtaggagaaatacctaatgtaaatgatgagttgatgggtgcagcaaacaaacatggcacatgtatacctatgtaacaaacctgcatgttgtgcacatgtaccctagaacttaaagtataataaaaaaagaataaaaatataaataaaagtaagtcttggtgaaaaaaacaaaacaaaacaaaaaaaactttgcccagaccaaatgtctagaagtgtttccccaatattttcttctcgtagtttcataatttggggtcttacattaaagtagttcattcattttgagttgatctttgcatgtggtgaaagagaggggtctagtttcgttattctgcatgtggatattctgttttcccagtaccatttatttaagaggctattccttccccagtactgttttggcatctttgttgaaaatcagttggctgtaaatatatgaatttatttctaggttcttgttgctgttctatttttatgctagtaccatgctgggtttgtttagcttcttgaatctgtaatgtttatgtcttttaccaaatttgtgaaaattttggt

SEQ ID NO: 2165 - DNA, 700 bp, Homo sapiens
cagtaccatttatttaagaggctattccttccccagtactgttttggcatctttgttgaaaatcagttggctgtaaatatatgaatttatttctaggttcttgttgctgttctatttttatgctagtaccatgctgggtttgtttagcttcttgaatctgtaatgtttatgtcttttaccaaatttgtgaaaattttggtcattctttctctagttagtttttctaccacattcttgtttttctttttctgggattcctcttacacatatgtaagacctttcattgttgtctgatagttccctgaggctctgttaatttgtttctctcttctctcttcttcagattatataatatccattgtctactgctaatctcaatgattcttccctctgtcatctctattttcatgttaaccccatctattaaagttttaaattcagatactgtatttttcagttctataatttttagttaattctttattgttgtttcttgttcttttctgaaacttgtcttcttttcactaactatgagtattatttttctttacgtcattgaacgtggctctaattaaccactctgaaatccttgtctgtgaattccaacatctgtttcatctttgggttgatctctgtgtcttttctcttggaaataggtcacatgtttctggtccttcacatgtcaagcaactttctattg

SEQ ID NO: 2166 - DNA, 700 bp, Homo sapiens
tttctgaaacttgtcttcttttcactaactatgagtattatttttctttacgtcattgaacgtggctctaattaaccactctgaaatccttgtctgtgaattccaacatctgtttcatctttgggttgatctctgtgtcttttctcttggaaataggtcacatgtttctggtccttcacatgtcaagcaactttctattgtatcctggttgctactgagggaactccagattctgttatattcctttgaagaatgttgtcttgaactcctgacctcaagtgatccacccaccttggcttcccaaagtggtggaattacagacatgagccaccatgcctggccggaagaatgttgttgttgttaattaccaagcaattaacttggttggacacaaactgcaaactgttttttgtgcagtatatttcttttattcctggctgggctacttgcagtataacctacatatgtgttgtttagcagtctgccggagatttgggcagagtttacacacagatggagtgtctccatgctcctctttttactgggatttcctttttacttttcagaatttgtgcttgctccagactctgtaatctgatattttaggttaagaaaactgggttttctatcaaaattttagcagctgtatatgccatcaactatggtatgtcctgaggctaatagtcattttaaaaacagg

SEQ ID NO: 2167 - DNA, 700 bp, Homo sapiens
agtttacacacagatggagtgtctccatgctcctctttttactgggatttcctttttacttttcagaatttgtgcttgctccagactctgtaatctgatattttaggttaagaaaactgggttttctatcaaaattttagcagctgtatatgccatcaactatggtatgtcctgaggctaatagtcattttaaaaacaggaaatcaccctgtactgttctcttcattcaagggtcaacttccacccattatctgcctgcttttgtttactctccattgacttctactaattgtattttgtattttatccagagtttatagttgttatctgtgtgtgggtcactgtgatagaaaaatattcaaccatatttttcacatcttttatttttaataaaaataatttactcatagtaattttttattcttatgattgatatatttggtttcaatttgatgtattattccaggttaattttctgtatttattattttatattttcctgttttactaggatatatcttggaattggccattctaggttaactccattctttgatttttcttctttcaaggattccaattatacctatgttgctcttctttgcgattcttttatatttatcactatttctggccctgtttacctctgtgttcatttttgcttcattttcttgacttttctcatcttcctctgtattgt

SEQ ID NO: 2168 - DNA, 700 bp, Homo sapiens
tgttttactaggatatatcttggaattggccattctaggttaactccattctttgatttttcttctttcaaggattccaattatacctatgttgctcttctttgcgattcttttatatttatcactatttctggccctgtttacctctgtgttcatttttgcttcattttcttgacttttctcatcttcctctgtattgtttagtacagttttggtcatatctctttctttcttaggcacattataatttagtatttgtttctacgattattttatcattttcttcaataactttcttgagtttgatcagtttctattttacatcttttgttgtccatatccattccgagtttttatatttctgatttttggcattctttcatatctacagttgtttgcttaattatatttaattaatcttactgtattttgttatagtttttctcttttttttttggataggtcaggattgttttgttgtgttttcaactcctgaaaaattttgattatattttatgtttttctatttatagtaacttatgtggatgttgggtttaattttatttttgttgttcctatgtttatttgtgttggattttcctgaaccagtgatcttgagtcaactgtttcttttatttctatagtgaaatgcagttttttcaattaaaggtacttttatggtatgtcttcttcaaattgt

SEQ ID NO: 2169 - DNA, 700 bp, Homo sapiens
ttttgattatattttatgtttttctatttatagtaacttatgtggatgttgggtttaattttatttttgttgttcctatgtttatttgtgttggattttcctgaaccagtgatcttgagtcaactgtttcttttatttctatagtgaaatgcagttttttcaattaaaggtacttttatggtatgtcttcttcaaattgtttcttaatgtataattttaatagggctcttactctcagccacttcattctcttcaccaccacacctccaaaggacagttcacttttcatggttcctctttcaccccaggaacagtgccttccttatactatctctgtgtgctttacaagctcttgtgtttaaaatatccataagccagtcctctgatgcactaagtctcagatgttctctctgtacttttccactcagggtggagcccttttcctctgaaagcaggaccttagatgatatatatgttacaccacattaaaagcacactgcatcatttactctttctgcagtcccagactggttctttgcatagttgtcactggagtactctgctgacatttaatatttatttattcacttctaagaaaacagaaatttgtactattctgtgtttcccggttacaacgtaggcataaataatgggtactttttttctttgttggtggttttcagaaatttatgtagttaaa

SEQ ID NO: 2170 - DNA, 700 bp, Homo sapiens
atcatttactctttctgcagtcccagactggttctttgcatagttgtcactggagtactctgctgacatttaatatttatttattcacttctaagaaaacagaaatttgtactattctgtgtttcccggttacaacgtaggcataaataatgggtactttttttctttgttggtggttttcagaaatttatgtagttaaaattgcttttagaaggatgtctttttctatgacaccttgttacatttcaaataatcagtgtcactaaccagaactttttcagctgtttgaatttgcttttcttttcagcaaatgacatatgctatgcatgaatgttaaaatagctgaaaagaattgcctgtatttaaatattaaaagaattgcctgtatttaaatactaaaagaatcacctatatttaaagaattgccttttatttgaataaaataaatatattgcctatgtttaaatgaaatagctgaaaaattgcctatatttaaatatttaaatacataaatctactattttttatgttaagtattttttttatcaatactcatttagcccttactagatcatcccttgagagcagtgccttctttggaaatagtcaagggatggaagaggcaagcttatttgaaaaaacttgtatcacttctactgtcatactttataaaacattttatttagaacatctcaacagg

SEQ ID NO: 2171 - DNA, 700 bp, Homo sapiens
ttaaatacataaatctactattttttatgttaagtattttttttatcaatactcatttagcccttactagatcatcccttgagagcagtgccttctttggaaatagtcaagggatggaagaggcaagcttatttgaaaaaacttgtatcacttctactgtcatactttataaaacattttatttagaacatctcaacaggggccaaaatgcctcatttctaactgccatacttcacacagaaatataggcatacctcagagctattgcaggttcagttctcgaccaccataataaagtgaatatcacaataacaagagagcctgtccgttgaagccaggcattgacatctctctagctatgaaagtcctagatggcaccttcttccaatggaagagtgtttcatctgcattgaaaatctgttgtttagtatagccaccttcatcagggatcttagctaggtcttctggatcacttactgtagcttctaccttgcattcttgggattaaaaactttattcgatcatgatgtcttatctgtctgatgtattgatggattcaacttactaatgtttttcttgcagattttaaaatctatgtacatgaggtatattgctctttaattttctttttctatattgtctttctctggttttgttatcagggcaatgctcacctcatgagttgggaactattccattc

SEQ ID NO: 2172 - DNA, 700 bp, Homo sapiens
gggattaaaaactttattcgatcatgatgtcttatctgtctgatgtattgatggattcaacttactaatgtttttcttgcagattttaaaatctatgtacatgaggtatattgctctttaattttctttttctatattgtctttctctggttttgttatcagggcaatgctcacctcatgagttgggaactattccattctcttctagtttccagaatagtttatatagaattgctagtatttcttacttacttggtagaattcactaaatggacccatttgtgctggaattttctttgttggaatatactttaataagcatgggatcgttcatattatttcttcttgaatgagcttttggtagtttgtgtctttcaaggaatgtgtttgtttcatccaagttgttaaatatattaatgtcagagaaatctgtgatagtccttctttgattcctgatataagcaatttgtttcttctttttttcaatatcagtttgactagaagcttctttaattgatcttttcaaggagttaacttttaaaaaaattttcaataggtttttggggaacaggtggtgtttggttaaatgagtaagttctttagtggtgatttttgagattttggtgcacttgtcacccaagcagtgtacactgtatccaatgtgtagccttttattcctcatcccttctcacttaccccc

SEQ ID NO: 2173 - DNA, 700 bp, Homo sapiens
gaagcttctttaattgatcttttcaaggagttaacttttaaaaaaattttcaataggtttttggggaacaggtggtgtttggttaaatgagtaagttctttagtggtgatttttgagattttggtgcacttgtcacccaagcagtgtacactgtatccaatgtgtagccttttattcctcatcccttctcacttacccccgaatccccaaagttcattgtattatatcattcttttgctttgcatccttatagcttagctcctacttatgagttagaacatacgatgtttggttttctattcctgatttacttcacttagaataatggtctccaattccatccaggttgctgagaatgccattattgtgttcattttttatgcctgagtagtattccatcatatgatttattttcatatgtcttgtgctactataaatatgcatgtgcaagtatcttttttgtataatgacttcttttcctctgggtggatacccaagagtgggatttctggatcaaatggtagatctacgtttagttctttaaggaatctccacactgttttccatagtggttgtacttagttctttaaggaatctccacattgttttctatagtggttgtactagtttacattcccaccaacagtgtaaaagtgctccgttttcactgcatccacaccaacatctattattttttgat

SEQ ID NO: 2174 - DNA, 700 bp, Homo sapiens
tgggatttctggatcaaatggtagatctacgtttagttctttaaggaatctccacactgttttccatagtggttgtacttagttctttaaggaatctccacattgttttctatagtggttgtactagtttacattcccaccaacagtgtaaaagtgctccgttttcactgcatccacaccaacatctattattttttgatattttgattatggccattctttcaggagtgaggtggtatcatatggtggttttgatttgcatttccttgatcattagtgatgttgagcattttttttaatatgtctgttggccatttctgtaccttcttttgagaattgtctattcatgtccttagtccactttctgatgggattgttttgttcttgctaatttgtttgagttccttgtagattctggatattagtcctttgttggatgtgtagattgtgaagattttctcccactctgtgggttgtctgttaactctgctgattatttcttttgcagtggagaagctttttagttaagtcccatctgtttatcttttttttttgtttgtttgtttgcttttgggttcttggtcatgaagtttttgccttctagtcagtgtctagaaggattttttcaatgttatcatctagaatctttatggtttcaggtcttggatttaagcctttgatccatcttgttgatttttgt

SEQ ID NO: 2175 - DNA, 700 bp, Homo sapiens
ttttgcagtggagaagctttttagttaagtcccatctgtttatcttttttttttgtttgtttgtttgcttttgggttcttggtcatgaagtttttgccttctagtcagtgtctagaaggattttttcaatgttatcatctagaatctttatggtttcaggtcttggatttaagcctttgatccatcttgttgatttttgtataaggtgagagatgaggatctggtttcattcttctacatgtggcttgtcagttatctcagcaccatttgttgaatagggtgtcctttctccaccttatatttttgtttgctttgtcgaagatcagttggctgtaagtatttgtctttatttctggattctgcaatctgttccattggtctatgtgcctgtttttatactaaataccaagctgttttggtgattatggccttatagtatagtttgaagtcagataatgtgatgcctccagattgttctttttgcttagtcttgctttggctgtggaggctcttttttggtttcatatgaattttaggattgttttttctagttctgtgaagaatgatgatggtattttaatgggaattgcattgactttgtagattgcttttggtggtatggtcattttcacaatgttgattctacccatccatgagcatgggatctgtttccatttgtttgtgccatctatgatttctt

SEQ ID NO: 2176 - DNA, 700 bp, Homo sapiens
tgtggaggctcttttttggtttcatatgaattttaggattgttttttctagttctgtgaagaatgatgatggtattttaatgggaattgcattgactttgtagattgcttttggtggtatggtcattttcacaatgttgattctacccatccatgagcatgggatctgtttccatttgtttgtgccatctatgatttctttcagcagtgttttatagttttccttgtagaggtctttcacctttcaaggagttaacctttggtttcacagattttctctattgtgtctctttgtcatatttcattgatttctgcccttctacataaattttttccttctacttgctttgcgtttaatttgttgttctttttctaggctcttagagtagcaggttaggttattgactggaaacttttcataaaaacatttaataatctacattttcttgtaagcattgttttgactatattgtgccaaaatttgaaaaaaaaattcttatattgggataaattttagatttatgtaatagttttaaatagaatatagagttctctcatatatttcatcatttcctctaatgttaataacttacataaccatggtacatttttcaaaactgaaaaattaacattgatatattactattaccttaagatccagactttattcagatttaaccaacttttctactaatgtcctt

SEQ ID NO: 2177 - DNA, 700 bp, Homo sapiens
ttgggataaattttagatttatgtaatagttttaaatagaatatagagttctctcatatatttcatcatttcctctaatgttaataacttacataaccatggtacatttttcaaaactgaaaaattaacattgatatattactattaccttaagatccagactttattcagatttaaccaacttttctactaatgtcctttttttgttctaggatccaacccaaaataccacagtgcatctagtcatcatgtctctttcatttattctttccttatttttaaagaccttgatggttattaagagtcatatgttttatagaagggccaccaacttagatttttctgatgttttcttatgattacaccaaagttatcaatttgagggaagaatgtacccttcatgttgcataattttaggggaacgtgactgatgaagtaaactttgatcacttggccaaggtcatcacacaagtatgatatgttgtccctacatgtaaatgcaactcagaatgttttctaatttcctttatgacttccactttgactcatgagttatttagaagcatgttgcttatttcacaaatatttggggattttccagatatttctgttattctaattttattctgttgtggtcagataacatactttgtgtgctttcagttattttaaatttgttgaggattgttttatgaccaag

SEQ ID NO: 2178 - DNA, 700 bp, Homo sapiens
caactcagaatgttttctaatttcctttatgacttccactttgactcatgagttatttagaagcatgttgcttatttcacaaatatttggggattttccagatatttctgttattctaattttattctgttgtggtcagataacatactttgtgtgctttcagttattttaaatttgttgaggattgttttatgaccaagaatatgatttagcttgatgaatgtttcatgtgcacttgaaaagaatgtgtattctgctgttgtttagttgaatgctctttaaatgtcaactaggtaaagttggttgatagtgttgttcaggtcttctgtatccttatttattttttctctattttttctatcatttattgaggactgttgaggtgtaactgtaattgtgggtttgtatgtttctattcaggtctatcatttttgcttcatgtattttgaaactcttggttaggtaagtacataattaggattgttatgtattcttggttaatttaccactttgtcatcctataatgtccctgttttcatatatatgaaaacagggacaagaaatattttatatatatatataaatttatatatatatataaaatatttcttgttctgaagtctccttttttgatactaatatagctgttctagctttcttttgatttatgtttcaacaatatatcattttccatcatttt

SEQ ID NO: 2179 - DNA, 700 bp, Homo sapiens
atttaccactttgtcatcctataatgtccctgttttcatatatatgaaaacagggacaagaaatattttatatatatatataaatttatatatatatataaaatatttcttgttctgaagtctccttttttgatactaatatagctgttctagctttcttttgatttatgtttcaacaatatatcattttccatcattttatttttattaaattaatgcacttcatttttaaaagaagttttaggtttacaaaaaacttagcataaagtacagtgcttctataatcccctacccccatatagtttctcctattattaacttcttgctttcacgtggtgtgttcattacaagtgatgcacaaatatggatacattattattattattattttgaggcagagtctctccctctgtcacccaggctggagtgcagtggcatgatctcgatctcggctcactgaaacctccgcctcctgagttcaagctattcttctgcctcagcctcccgagtagctggatctacaggcatgcaccaccatgcccggctaattttttcatttttagtagagacggggtttcaccatgttggccaggctggtctcaaagtgcggggattacaggcatgagccacagcacccagcctgatacattattattaactaaagtccacaattcacattagagttctctctttgtgttgt

SEQ ID NO: 2180 - DNA, 700 bp, Homo sapiens
cctcccgagtagctggatctacaggcatgcaccaccatgcccggctaattttttcatttttagtagagacggggtttcaccatgttggccaggctggtctcaaagtgcggggattacaggcatgagccacagcacccagcctgatacattattattaactaaagtccacaattcacattagagttctctctttgtgttgtacagttctgtagattttgacaattgtatgacatgtgtccaccgttacagttttatacagcataatttcattgccaaaaaaatgttctgtgctccacttattcatcattccctctgcccgcaaactcttggcaaccactggtctttctaccatctgtatagttttgccttttccagaatgtgatgtaatttgagtcatacattatttagccttctcagattggtttctttcacttagcaacatgcatttaaggtttccccctgtctttttgtggcttgatagctcatttccttatattgccaaataatattttattgtatggctgtatcagtttgtttatccattcatctattggaggatgtcttggttgtatccaggttttggcaattatgaataaagctactgtgaacatttgtatgcaggtgtttgggtgtacttggattttcaactgatttgggtaaataccaagcagcatgatcgctggattgtatagtaagacta

SEQ ID NO: 2181 - DNA, 700 bp, Homo sapiens
aaataatattttattgtatggctgtatcagtttgtttatccattcatctattggaggatgtcttggttgtatccaggttttggcaattatgaataaagctactgtgaacatttgtatgcaggtgtttgggtgtacttggattttcaactgatttgggtaaataccaagcagcatgatcgctggattgtatagtaagactatgtttagctttgtaagaaactgctgaactctcttccaaaatggctatagcattttgcattcctaccaacagtgtataagagtttctatagctatatatcctcaccaatatttggtgttgcctgtgttttggattttcatcattctgacagatgcatagtgatatctcattggtgttttaatttgcaattccctaatgacatataatatttagcgtttttttccccccgagatggagtctggctctgttgcccaggctggagtgcagtggtgcggtctcagcccattgcaacctctgcctctcgagttcaagcaattctcctgcctcagcctcccaagcagctgggattacaggcgcctgccaccatgcatggctaatttttgtatttttagtagagaaggggtttcaccatgttgaccagactggtctccaactcctgacctcgtgatctgcctgcctcagcctcccaaactgctgggattacaggtgtgagccaccacg

SEQ ID NO: 2182 - DNA, 700 bp, Homo sapiens
tcgagttcaagcaattctcctgcctcagcctcccaagcagctgggattacaggcgcctgccaccatgcatggctaatttttgtatttttagtagagaaggggtttcaccatgttgaccagactggtctccaactcctgacctcgtgatctgcctgcctcagcctcccaaactgctgggattacaggtgtgagccaccacgcctggccaatatttagcatcttttcatatacttacttgccatttgtatatcatctttgatgaggtgtgtttgtttagatatttttgcccatttttaaagttgggttatttattttcttattgttgagttttgagagttctttatatatttttaataacagtcctttatcagatacgtgttttgcaaatattttctcccagtctgtggcttttctttttattctcttgacatattttacttttaacccatctttgcctttatgtttagagtgagctccttatagaaagcatataatcatgccttgctttttcatccaattggacaatctcttttaatattgtatgtttagatcatttatacttaatatagttattgatatagttggactaaaatctgtcatttttcttgctattttttatttgttccatctgttttttgttctttttttccccttttctgcctgcttttgaattggctattttcttttattatactttaag

SEQ ID NO: 2183 - DNA, 700 bp, Homo sapiens
cttgctttttcatccaattggacaatctcttttaatattgtatgtttagatcatttatacttaatatagttattgatatagttggactaaaatctgtcatttttcttgctattttttatttgttccatctgttttttgttctttttttccccttttctgcctgcttttgaattggctattttcttttattatactttaagttttagggtacatgtgcacaatgtgcaggtttgttacatatgtatacatgtgccatgttggtgtgctgcccccattaactcgtcatttacattaggtatatctcctaatgctatccctcccctctccccctacccgacaacaggccctggtgtgtgatgttccccttcctctgtccatgcgttctcattgttcaattcccacctacgagtgagaacatgcggtgtttggattttttgtccttgtgatagtttgctgagaatgatggtttccagcttcatccatgtccctacaaaggacatgaactcatcattttttatggctgcatagcattccatggtgtatatgtgccacattttcttaatccagtctatcattgttggactattttttatgctgtttttttccttcctttattggcttatttataacctcttttaagaaaattttagtggttgtccttaagtttacagtatgcacctttaattaatcacagtcagcc

SEQ ID NO: 2184 - DNA, 700 bp, Homo sapiens
gaactcatcattttttatggctgcatagcattccatggtgtatatgtgccacattttcttaatccagtctatcattgttggactattttttatgctgtttttttccttcctttattggcttatttataacctcttttaagaaaattttagtggttgtccttaagtttacagtatgcacctttaattaatcacagtcagccttcaaatagtacgtataatatatataaggtttaagaaccttatgatactcctaattttttcctcccaattttgtgctatagttttcatgcactttattatatgctgtattccaacacactgctactattttttgctttagacaattatgttttagataattaaaaataagaaaaagtattttatgtttatcttcatttatccattcccagacatctttattactttgtgtagattcaagttcttgtagggcaggtctgtggataatgaattatctcagcttttatttgtctgaaaagatatttaggaatttgagtttccagtccagcatgttaggagttttaaaaagttgccactccatcctaacaacaaataaaaactgaacaagctgaagaattaacaactcttcttagatctataagagaggtgaggtcacaaggtaaacttctgcccccagaattggggagaaaaacaggcagatacagaaaatcacaacttacca

SEQ ID NO: 2185 - DNA, 700 bp, Homo sapiens
tttaggaatttgagtttccagtccagcatgttaggagttttaaaaagttgccactccatcctaacaacaaataaaaactgaacaagctgaagaattaacaactcttcttagatctataagagaggtgaggtcacaaggtaaacttctgcccccagaattggggagaaaaacaggcagatacagaaaatcacaacttaccagagcggaaactcacctccatgagaagaagtaccgggatagaaaaacctgaactatagttgacaaattgtggaggctcagtgtggacaagcctgagtaataaaaaccccaggggatcccagtcatcaggtatccctcacacttctgtaagttttatgtgaagattggagaaaaatctccttatgcttccagcagggggaggaaaaaggaacgtttttgtaatatgtcaagagcattctgttcttgaccagacctgagcctaacctgctgaagttttgtttaagagctcgacccatctggggcaagggaaataactccagccccctctggctatcctttcccatttaaaggggggataaaaagctgaaaacgactggtgaagttcattgtctagcaacacaggctcaccagaagactgagatctaatcataggactatggaacacttccctgccctccatatcttaccactacattactaaaagcctatgtagccaggcgcg

SEQ ID NO: 2186 - DNA, 700 bp, Homo sapiens
caagggaaataactccagccccctctggctatcctttcccatttaaaggggggataaaaagctgaaaacgactggtgaagttcattgtctagcaacacaggctcaccagaagactgagatctaatcataggactatggaacacttccctgccctccatatcttaccactacattactaaaagcctatgtagccaggcgcggcgtctcacgcctataatcccagcactttgggaggccaaggcgggagaatcacttgaggccaggagttcaagaccatcctggccaatatggtgaaaccccatctctactaaaattacaaaaaatagctgggcttggtggcacacacctgtaatcccagctacgtgggaggctgaggcaggagaaccacttgaacccgggaggcagaggttgcagtgagctgagatcacgccactgcactccagcctgggcaacaaagtgcgactctgtctcaaaaacaaacaaataaacacacaacctaaaagtctttttaccacaattccttttaccccgtacacctttcagcagtatactacaaggcatattaaaaggcaaaaaacacaattggaagagacagagcaaccatcagaatcagacccatatgtggcaaggatgtgagaattatcagactgggaattttaaacaactatgattaatatgccaagggcactaatagaaaaag

SEQ ID NO: 2187 - DNA, 700 bp, Homo sapiens
aagtctttttaccacaattccttttaccccgtacacctttcagcagtatactacaaggcatattaaaaggcaaaaaacacaattggaagagacagagcaaccatcagaatcagacccatatgtggcaaggatgtgagaattatcagactgggaattttaaacaactatgattaatatgccaagggcactaatagaaaaagtaggtaacatgcaagaacagatgagtaatgtaagcagagaaatgcaaactctaagaaagatttaaatcaaatgaagatgctggaaataaaaacatagtaactgaaattaagaatacctttggttaagctcatcagtatactggacacagatgaggaaagaaacagtgagacttaagatatgtcaatagaaatttcccaaaatgaaaggcaaagaggaaataaaactttaaaaaacagaatatccaagaactgtaagacaaccacaaaaatgtaagtacatataatgatagtattggagaagaaactgagaaaggaacagaagcaatatttgaagcagtaaggaaataattttcctcaaattaatgtcagacatcaaaccacagatctaagaatcagagaacaccaaataggataaaattttaaaaagccccaaaaatgaaaaactatacctaggcatatcatattaaaactgcagaaattttcagataaagaaaaaaaat

SEQ ID NO: 2188 - DNA, 700 bp, Homo sapiens
gaaactgagaaaggaacagaagcaatatttgaagcagtaaggaaataattttcctcaaattaatgtcagacatcaaaccacagatctaagaatcagagaacaccaaataggataaaattttaaaaagccccaaaaatgaaaaactatacctaggcatatcatattaaaactgcagaaattttcagataaagaaaaaaaatcttgaaagaaagccgggggtggaggggggaatcttatctataaaggagcaaagataagaaatatttctcctcctgagaaatcatgcaagcaagaaaaaattggagtgaaaaatcaaagcattgagagaaaaaaaaaaaaccccaccaacctacaattctgtccctgcaaaattatccttcaaaagtgaagatgagataaagactttctcagataaacaaaaactgaatgaaattgttgccagtagatcttccttgtaagaaatgtttaaaagaagttgttcagggagaaggaaaatgatataggtcagaatctcagatctatataaagaaagcatcagagaaggagtaagtaaatataaaataaacacatttttcttattcttaattgatgtaactgataacagtttgtttaacaatattaacaatgcattcaattttgtgtgtgtatataaatatatacatttatgtgtgcttatgaataagtgaaatgaatgacagca

SEQ ID NO: 2189 - DNA, 700 bp, Homo sapiens
taggtcagaatctcagatctatataaagaaagcatcagagaaggagtaagtaaatataaaataaacacatttttcttattcttaattgatgtaactgataacagtttgtttaacaatattaacaatgcattcaattttgtgtgtgtatataaatatatacatttatgtgtgcttatgaataagtgaaatgaatgacagcagtgatgcaagggatgggagggagaattagaaatacttggttattaggtacttgcactgtatgggaagtggtatagtattatttgaaaatggattggggttagttataaatgcatatttcaaactctagggcaaccactttaaaaagtaagaaaaagaagtataattggtatgctaagaaaagagagaaaatggaatcatataaaatgctcaattaaaaccacggaaggcagaaaaagagtggaagacagaaataggaacaaagaacaaaggcaacaaatagaaaatagtaacagatatggcagatcaaactatatcagtaaacacttcacagtcactctggaaggcagtttggctgtctcttaccaaactaaacatgctcttagcacatgatccagcccttgcactccttagaatttacccaaataagttaaaaacttatgttcacccagaacagctgcatacagctgtttatagcagctttcttcatagttgcgaaaac

SEQ ID NO: 2190 - DNA, 700 bp, Homo sapiens
cagatcaaactatatcagtaaacacttcacagtcactctggaaggcagtttggctgtctcttaccaaactaaacatgctcttagcacatgatccagcccttgcactccttagaatttacccaaataagttaaaaacttatgttcacccagaacagctgcatacagctgtttatagcagctttcttcatagttgcgaaaacctggaagcaaccaagatgtcttgcttccaggtttggaaggatggatgggtaaataaactgatacatccaggcaatgaaatattgttcagtgctaaaaggaaatgcactatcaagctataaaaagacatggaggaaccttaaatgcatattgctaagtgaaagaagctcatctgagaaggccagcttcaagtgattctcatgcctcaacctctcaagtagctgggattacaggcacgtgccaccatgcctggctaattttttcatttttagtagagacaaggtttcaccatgttggccatgctggtcttgaactcttgacctcaagtgatccgcccaccttggcctcccaaagtggtaggattacaggcatgagccaccatgcccacccccattatacgtttgtcaaaacccacagaatgtacgccaccaagagtgaaccctaatataaactgtggacctggggtgataattatgtgacaatgtaggttcattgatctaac

SEQ ID NO: 2191 - DNA, 700 bp, Homo sapiens
ctggtcttgaactcttgacctcaagtgatccgcccaccttggcctcccaaagtggtaggattacaggcatgagccaccatgcccacccccattatacgtttgtcaaaacccacagaatgtacgccaccaagagtgaaccctaatataaactgtggacctggggtgataattatgtgacaatgtaggttcattgatctaacacatgtaccactgtgacgcagtacatcaatagtggggatgtttatgcatgtgtaggggcatggatagatgaggagtctgtacttcctgcttaattttgctgtgaacctaaaactgctgttttttaaaagattttttccccttcagtttaaaagattatttcacttggtgtagaattctgggttgatagcaattttttttcttttattcctttaaagatctcacaccattgtcttctggattatataatttctgaatatgtctgctgtaattcttatcttgtttatctgtgtgtaatgtttctttttatcttgtcatgtttaagattttctatttgtttttggttttcagcagtttaaatataacgtatctttctaagcgtgatttcttttagtggtggtggtggggtatttatcctgattgtgacctctgagtttatttttttaaaaaatacatatatatatttaatatatatttaaatgtatattttttatatatttat

SEQ ID NO: 2192 - DNA, 700 bp, Homo sapiens
ctttttatcttgtcatgtttaagattttctatttgtttttggttttcagcagtttaaatataacgtatctttctaagcgtgatttcttttagtggtggtggtggggtatttatcctgattgtgacctctgagtttatttttttaaaaaatacatatatatatttaatatatatttaaatgtatattttttatatatttatttattttagagacagggtcttgctgtgttgtccagactggtgttgaactcctggtttcaagcgatcctcccacctgggattacaggcatgagccactatgcccaatcatctctctgagcttcttggatctgtagtttgtatctttcattattttctgaagattcttggctaatttctctttaaatatttcttctttaaaaaatatctacttcaaatacctaatatagatgacgggttgatgggtgcagcaaaccatcatggcatgtgtatacctatgtaacaaacctgcacgttctgcacatgtatcccagaacttaaagtataataaaaaaaatttttaaaaagaaaaattaaaatctacttccttcctctggaattttaaggcttaggagaagagttgtgtacatgtccagaagaaaagtggagttgagtcagtttattaggatgtggtgtgggtttgggatttttttgtttttgtttttgtggttgctttcagtgta

SEQ ID NO: 2193 - DNA, 700 bp, Homo sapiens
atgtatcccagaacttaaagtataataaaaaaaatttttaaaaagaaaaattaaaatctacttccttcctctggaattttaaggcttaggagaagagttgtgtacatgtccagaagaaaagtggagttgagtcagtttattaggatgtggtgtgggtttgggatttttttgtttttgtttttgtggttgctttcagtgtacctccaacttcaaagcattgtgcttagagtagaggctgggtttccagaggttttttgttttgttttcttaaaatgttcctgctttacttgcagctttcagaattcccagtggacctgtaccttggagggatgtttcttgatgcatgcttgccccttgtccagcagtggtctcctgttccttgttactcatgcttgctagtccagtgatggggaccagtgaggactctctactgtcctggtccagcctcactattagacaggctaaaagttctgtcagcctgtgggaagggcaggaaatggtctggcccaagttcattagaggtttttgttattggtttgtttgtttgtttgtttgtttgttttgagacagagtcttgttctgtcacccaggctggagtgcagtggtgcgatctcagctcactgcaacttctgcctcctgggttcaagcaattctcctgcctcagctcctgagtagaggggattacaggcatgtgccacta

SEQ ID NO: 2194 - DNA, 700 bp, Homo sapiens
tctggcccaagttcattagaggtttttgttattggtttgtttgtttgtttgtttgtttgttttgagacagagtcttgttctgtcacccaggctggagtgcagtggtgcgatctcagctcactgcaacttctgcctcctgggttcaagcaattctcctgcctcagctcctgagtagaggggattacaggcatgtgccactatgcccaactaatttttgtatttttagtagagaaggggttttgccatgttggccaggcttgtctcaaactcctgacctcaagtgatccacccacttcagcctcccaaagtgttgagattacaggtgtgagctatcgcacctggccatgaggtgttctaccactgttggaagggtagaatgttctttccaggtcaagatccatcaaagaaacaaggaaaagtttggctgtctcagagaggggatcaggatcaccaggaaatctccagacatggagaaccagtctttcttgtgagcatccagtaaaggtctgtggagaaaaatgtatgagagaggtgtgaatttttcttgtgtctgtgactcccaggaatttcatattcacacattagcccacaatttgcctttagtaatttttttttttaaaagctccagtctgcagctcccagtgagaccaacgcagaaggtgggtgatttccagctgaggtgcccggttcatctcattgg

SEQ ID NO: 2195 - DNA, 700 bp, Homo sapiens
aaaggtctgtggagaaaaatgtatgagagaggtgtgaatttttcttgtgtctgtgactcccaggaatttcatattcacacattagcccacaatttgcctttagtaatttttttttttaaaagctccagtctgcagctcccagtgagaccaacgcagaaggtgggtgatttccagctgaggtgcccggttcatctcattgggactagttaggcagtgggtgccacccacagagagcaagcagaagcagggtggggcatcgcttcacctgggaagtgcaaggagccaggggacctcccttccacagccaagggaagtggtgagggactgtgctaccctccctggatactacacttttcccgtggatttttgcaatctgcagatcaggagattccctcgtgaacttacaccaccagagccctgggtttcaagcacaaaactgagcagctgattgggcaggcactgagctagctacaggagtttttttgtactccagcggcacctggaaccataatgagacaggagacaggagagacaggagaaccgtccactcccctagaaagggggctgaagccagggagccaagtggtcttgctcagcaggtcccactcccacagatcccagcaagctaagaaccactggcttgaaattctcactgccagcacagcagtctggagttgacccagaatgatcgagcttggtg

SEQ ID NO: 2196 - DNA, 700 bp, Homo sapiens
tggaaccataatgagacaggagacaggagagacaggagaaccgtccactcccctagaaagggggctgaagccagggagccaagtggtcttgctcagcaggtcccactcccacagatcccagcaagctaagaaccactggcttgaaattctcactgccagcacagcagtctggagttgacccagaatgatcgagcttggtggcgggaggggcatccaccagtactgaggcattagtaggcggttttcccctgacagtgctaaggagactgggaggtttggaatgggcagaatttaccacagcatggcaaagtgactgtggccagattgcttctctagattcctcctcactgggcagggcatctctgaaggaaaatcagcagctccagtcaggggcttacagataaaactctcatcttcctggtacagagcatctggagggaagggcagctgcagtcacaacttcagcagacttatatctttcctgcctcctggctctgaagaaagcaactgatcctgacaagggggattattccagcacagtgtactagctctgctaaggaacagactgccttctcaagtgggtccctgacccctgtgcctctgactgggagagacctcccaacagggatcaacagacacctcatacaggagagctctggctggcatcaggccagtgccccctgggatgaagcttccagag

SEQ ID NO: 2197 - DNA, 700 bp, Homo sapiens
aaagcaactgatcctgacaagggggattattccagcacagtgtactagctctgctaaggaacagactgccttctcaagtgggtccctgacccctgtgcctctgactgggagagacctcccaacagggatcaacagacacctcatacaggagagctctggctggcatcaggccagtgccccctgggatgaagcttccagaggaaggagcaggcagcaatctttgctgttctgcagcctccactggtgatacccaggtgaacagggtctggagttgacctccagcaaactacagcagacctgcagaagaggggcctgactgttagaaggaaaactaacaaacagaaagcagcaacaacaacaacataaaaaagatccccacacaagaaccccatccaaaggtcattagcctcaaagatcaaaggtagataaatccatgaagatgaggaaaaaccagtacagaaatgctgaaaattccaaaagccagaatgcctcttctcctccaactgattgcagcacctctccagcaagggtgtaaaactggacagagaatgagattgatgaattgacagaagtaggcttcagaagatgggtaataacaaattcctctgagctaaaggagcacgttctcacccaatgcaaggaagctaagaacctaataaaaggttacaggaactactaactagaataaccagttcagaga

SEQ ID NO: 2198 - DNA, 700 bp, Homo sapiens
caactgattgcagcacctctccagcaagggtgtaaaactggacagagaatgagattgatgaattgacagaagtaggcttcagaagatgggtaataacaaattcctctgagctaaaggagcacgttctcacccaatgcaaggaagctaagaacctaataaaaggttacaggaactactaactagaataaccagttcagagaggaatataaatgacctgatgtagctgaaaaaacagcatgataatttagtgaagcataaacaagtattagtagccaaatcacgtggaagaaaggatgtcagaaattgaagaccaccttgctgaaataaagcatgaagacaagattagagaaaaaggaatgaaaaggaatgaacaaagcctccacaaaatatgtgactatgtgaaaggaccaaacctacaattaatgggtgtacctgaaagtgatggggagattggaaccaagttggaaaacacacttcaggatattatccagaacttccccaacctagcaagataggccaatattcaaattcaggaaatacagagaacaccacaaaaatactccttgagaagatcagccccaagacacataatcttcagattcaccaaggttgaaatgaaggaaaaaatgttaagggcagccagaaagaaaggtcgggtcacgtacaaagggaagcccatcagactaacagcagatctctc

SEQ ID NO: 2199 - DNA, 700 bp, Homo sapiens
aacctagcaagataggccaatattcaaattcaggaaatacagagaacaccacaaaaatactccttgagaagatcagccccaagacacataatcttcagattcaccaaggttgaaatgaaggaaaaaatgttaagggcagccagaaagaaaggtcgggtcacgtacaaagggaagcccatcagactaacagcagatctctctgcaaaaaccctacaagccagaagagcatgggagccaatattcaacattcttaaagaaaagaattttcaacccagaattttatatccagccaaactaagtttcataagcaaaagagaaataaagtccttgagagacaagcaaatactgaggattttgtcaccaccaggcctgccttgcaagagcacctgaaggaaacactaactatggaaaggaaaaactggtaccagccattgcaaaaacacatcaaaatataaagaccatcaacactatgaagaaactgcatcaactaatgtgcaaaatagccagctagcatcatgatgacaggatcagattcacacacaataatattaaccttaaatgtaaatgggctaaatgccccagttaaaagacacagactggcaaattggataaagagtaaagacccatccatgtgctgtattcagtagacccatctcatgtgcaaagacacacataggctcaaaataaagggatggaggga

SEQ ID NO: 2200 - DNA, 700 bp, Homo sapiens
tagccagctagcatcatgatgacaggatcagattcacacacaataatattaaccttaaatgtaaatgggctaaatgccccagttaaaagacacagactggcaaattggataaagagtaaagacccatccatgtgctgtattcagtagacccatctcatgtgcaaagacacacataggctcaaaataaagggatggagggatatttaccaagcaaatggaaagcaaaaaaagtaggagttgcagtcctagtctccgataacacatactttaaaccaacaaagatcataaaagacaaagaggggcattacataatggtaaagggatcaatgcaacaagaagagctaactctcctaaatgtacatgcacccaatacaggagcacccagattcataaaacaagttcttagagatgtacaaagagacttagactcccacacaataaaaaagggagactttaacaccccactttcaatattagatggatcaacgagacagaaaattaacaaggatattcaggatgtgaactcagctctggatcaaggggacctaatagacatctacagaactctccaccccaaatcaacagaatatttattcttctcagcaccacatggcacttattctaaaattgaccacatgattgggagtaaaacactcctcagcaaatgcagaagaatggaaataataacagtctgtcagac

SEQ ID NO: 2201 - DNA, 700 bp, Homo sapiens
aacaaggatattcaggatgtgaactcagctctggatcaaggggacctaatagacatctacagaactctccaccccaaatcaacagaatatttattcttctcagcaccacatggcacttattctaaaattgaccacatgattgggagtaaaacactcctcagcaaatgcagaagaatggaaataataacagtctgtcagaccacagtgtgattagcattaagaagctcactcaaaacctcacaactacatggaaattgaacaatgtgctcctgaatgactactgggtaaataacaaaattaaggcagaaatcaagaagttctttgaaaccaatgagaacaaagactcaacatgccagaatctctgggacatagctaaagtagtgttaagagagaaatttatagcactaaaggcccacatcagaaagctggaaagatctcaaattgacaccctaacatcacaattaaaaggattagaaagcaggagcaaacaaattcaaaaactagcagaagacaagaaataactaagattagatcagaactgaaggagatagaggcacaaaaaacccttcaaaaatcagtgaatccaggaggtggttttttgaaaaaaaaaaaaaaattaacaaaatagatagactcctagctagactagtaaagaagaaaagagaagaatcaaatagacacaataaaaatgataaagaga

SEQ ID NO: 2202 - DNA, 700 bp, Homo sapiens
ctagcagaagacaagaaataactaagattagatcagaactgaaggagatagaggcacaaaaaacccttcaaaaatcagtgaatccaggaggtggttttttgaaaaaaaaaaaaaaattaacaaaatagatagactcctagctagactagtaaagaagaaaagagaagaatcaaatagacacaataaaaatgataaagagaatatcagcactgatcccacagaaatgcacactaccatcagagaatactataaacacatctacacaagtaaactagaaaatctagaaaaaatggataaattcctggacacatacatcctcccaagactaaaccaggaagaagtcgagtccctgaatagaccaataacaagttctgaaatcgaggcaataattaatagcctaccaaccaaaaaaatcccaggaccagacagatttcacaaccaatttctaccagaggtacaaagaggagctggtaccattccttctgaaactattctaaataattgaaaaagaggcactcctcctgaactcattttatgaggccagcatcatcctaataccaaaaccttgcagagacataacaaaaacagaaaacttcaggccaatatccctgatgaacattgatgagaaaatcctcaataaaatactggcaaaccaaatctagcagcacatcaaaaaagttatccaccacaatcaagtcag

SEQ ID NO: 2203 - DNA, 700 bp, Homo sapiens
attgaaaaagaggcactcctcctgaactcattttatgaggccagcatcatcctaataccaaaaccttgcagagacataacaaaaacagaaaacttcaggccaatatccctgatgaacattgatgagaaaatcctcaataaaatactggcaaaccaaatctagcagcacatcaaaaaagttatccaccacaatcaagtcagcttcatccctgggatgcatggctggttcaacatatgcaaatcaataagcgtaatccatcacataaacagaaccaatgacaaaaactgcatgattttctcaatggatgcagaaaacgccttcaataaaattcaacatcccttcatgctaaaaactctcaataaactaggtattcatggaacatatctcaaaataataagagctatttatgacaaacccacagccaatatcatactgaatgggcaaaagctggaagcattctctttgaaaacccagcacgagacaaggatgccctctcttaccactcctattcaacatagtattggaagttctggccagggcaatcaggcaaaagaaagaaataaagggttcaaataggaagagaggaagtcaaattgtctctgtttacagatgacatgattctatatttagaaaaccctattgtcttgcccaaaatctctctaagctgataagcaaatttagcaaagtctcagggtacaaa

SEQ ID NO: 2204 - DNA, 700 bp, Homo sapiens
cactcctattcaacatagtattggaagttctggccagggcaatcaggcaaaagaaagaaataaagggttcaaataggaagagaggaagtcaaattgtctctgtttacagatgacatgattctatatttagaaaaccctattgtcttgcccaaaatctctctaagctgataagcaaatttagcaaagtctcagggtacaaaaccaatgtgcaaaaattacaagcattcctatacaccaacaatagacaagcagagagccgaatcatgaatgaactctctttcacaattgctacaaagatagtaaaatacctaggaatacaacttacaagggatgtgaaggacctcttcaaggagaacaacaaacaactgctcaaagaaataagagaggacacaaacaaatggaaaaacattccatgctcatggatagaaagaatcaatattgtgaaaattgccatactgcccaaagtaatttatagattcaatgctgttcccatcaagctaccattgactttctttgcagaattaaaaaaactactttgaatttcatatggaacctaaaaagaacctgtatagccaagacctaagcaaaaacaacaaagctggaggcatcacgctccctgacatcaaactatactacaaggctacagtaagcaaaacagcatggtactgctaccaaaacagatatatagaccaatggacca

SEQ ID NO: 2205 - DNA, 700 bp, Homo sapiens
ccattgactttctttgcagaattaaaaaaactactttgaatttcatatggaacctaaaaagaacctgtatagccaagacctaagcaaaaacaacaaagctggaggcatcacgctccctgacatcaaactatactacaaggctacagtaagcaaaacagcatggtactgctaccaaaacagatatatagaccaatggaccagaacagagacctcagaagtaacaccacacatctacaaccatctgatctttgacaaacctgacaaaagcaatggggaaaggattccctatttaataaatgatgctgggaaaactggctaaccatatgcagaaaactgaaacttccttataccttatacaaaaattaactcaagatggattaaagacttaaatggaaaacccaaaaccataaaaaccctagaagaaaaacctaggcaataccattcagaacataggcatggacaaagacttcatgattaaaacaccaaaagcaatggcaacaaaagccaaaatagacaaatgggatctaattaaactaaagagcttctgcacagcaaaagaaactatcatcagagtgaacaggcaaccgacagaatgggagaaaatttttgcagtctacccatctgacaaaggtctagtatccagtatctacaaggaacttaaacaaatttacaagaaaaatcaaatgaccccgtgaaaaag

SEQ ID NO: 2206 - DNA, 700 bp, Homo sapiens
aaagccaaaatagacaaatgggatctaattaaactaaagagcttctgcacagcaaaagaaactatcatcagagtgaacaggcaaccgacagaatgggagaaaatttttgcagtctacccatctgacaaaggtctagtatccagtatctacaaggaacttaaacaaatttacaagaaaaatcaaatgaccccgtgaaaaagtgggcaaagtgtatgaacagaaaattctcaaaaaagacatttatgtggccaacaaacatatggaaaaaggctcatcatcccaccattagagaaatgcaaatcaaaaccacagtgagataccatctcatgtaagtcagaatggtgattattaaaagtcaggaaacagtagatggtgacgaggctgtggagaaataggaatgcttttacagtgttggtgggagtgtaaattagttcaaccattgtggaagacaatgtggcgatacctcaaggttctagaatcagaactaccatttgacccagcaatcccattactgggtatatacctaaaggattagaaatcattctataaagacacatgtgcatgtatgtttattgcagcactatttacaatagcaaagacttggaaccaacccaaatgtccatcaatgctagactggatatacaccatggaatactacgcaaccataaaaaagaatgagatcgtctcctttgcaggtaca

SEQ ID NO: 2207 - DNA, 700 bp, Homo sapiens
caatcccattactgggtatatacctaaaggattagaaatcattctataaagacacatgtgcatgtatgtttattgcagcactatttacaatagcaaagacttggaaccaacccaaatgtccatcaatgctagactggatatacaccatggaatactacgcaaccataaaaaagaatgagatcgtctcctttgcaggtacatggatgaagctggaagccatcattctcagcaaactaacacaggaacagaaaaccaaacactgcatgttctcactcataagtgggagttgaacaatgagaacacatggacacaggaaggagaacaacacacgtcaaggtctgttagggggtggggggcaaggagagggagagcattaggacagatacctaacgtaagcagggcttaaaacctagatgacgggttgataggtgcagcaaaccatgatggcacgtgtatacttatgtaacaaacctgcacattctgcacatgcatcccagatatcaaagtaagattaaaaaataaataaaaatgaaaaagacaaaaaaaaccccacagaaattatttttacctgcttctatgttgcccagtgtttcttccttttgtgttctgccacagatgacccagtgctcatgtctcatttctctttggtggcatctatcttttcttacattttagacttttttttttttttttttttgag

SEQ ID NO: 2208 - DNA, 700 bp, Homo sapiens
tcaaagtaagattaaaaaataaataaaaatgaaaaagacaaaaaaaaccccacagaaattatttttacctgcttctatgttgcccagtgtttcttccttttgtgttctgccacagatgacccagtgctcatgtctcatttctctttggtggcatctatcttttcttacattttagacttttttttttttttttttttgagatggagtctcactccgttgcctaggctggaatgcagtggcaagatctcagctcactgcaacctccacctcccaggtgcaagtgattctcttgcttcagcctcctgagtagctgggattacatgcacatgccaccatgcctggctgattttttggtatttttagtagagatggggtttcaccatgttggccaggctagtcttgaactcctgacctcaggtgatccacccgcctcagcctcccaaagtgctggaatgacaggcataagacaccatgcccggcccattttagactttttgattgccctatgatctcagttctctaatgagtttaggaaaagttatgattttgtagtttatctggctattgttgctgttaggatgtaatactcatcccagctttccacatcctgcaatttctttgtgttttaagaattttttttaatttatactttaagttctggggtatctgtgcagaatgtgcagttttgttacataggtat

SEQ ID NO: 2209 - DNA, 700 bp, Homo sapiens
gccctatgatctcagttctctaatgagtttaggaaaagttatgattttgtagtttatctggctattgttgctgttaggatgtaatactcatcccagctttccacatcctgcaatttctttgtgttttaagaattttttttaatttatactttaagttctggggtatctgtgcagaatgtgcagttttgttacataggtatacacgtgccatggtggtttactgcacccatgaacctgtcatctacattagttatttcccctaatactatccctcccctagcccccaacttcccgacaggccctgaggtgtgatattcccctccctgtgtccatgtgttctcattgttcaactcccacttatgagtgagaacatgcagtgtttggttttctgttcctgtgttaattttgctgagaatgatggtttccagcttcatccatgtccttgcaaaggactcatcgttttttatggctgcatagtattccatggtgtatatgtgccacattttctttatccagtatatcactgatgggcatttgggttggttccaagtctttgctgttgtgtacagtgccgcaaataaacatacgtgtgcatgtgtcttcatagtacaatgatttataatcttttgggtatatacccagtaatgggattgctgggtcaaatagtagttctggttctagatccttgaggaatcaccac

SEQ ID NO: 2210 - DNA, 700 bp, Homo sapiens
cattttctttatccagtatatcactgatgggcatttgggttggttccaagtctttgctgttgtgtacagtgccgcaaataaacatacgtgtgcatgtgtcttcatagtacaatgatttataatcttttgggtatatacccagtaatgggattgctgggtcaaatagtagttctggttctagatccttgaggaatcaccacattgtcttccacaatggctaaactaatttacactcccaccaacactgtaaaagtgttactatttctccacatcctctccagcatctgttgtttccagactttttaatgattgccattctaactggcgtgagatgggtatctcattgtgatttcgatttgcatttctctaatgaccagtgatgatgagctttttttcgtatgtttgttggctgcataaatgtcttcttttgagaagtgtctgttcatatcctttgcccactttttgatggggttggtttttttcttgtaaatttgtttaagttccttgtagattctggatattagccctttgtcagatggatagattgcaaacattttctcccattctgcaggttgcctgttcactctgacgatagtttttttttctgtgcagaagctctttagtttaattagatcccatttgtcaattttggcttttgttgccattacttttggtgttttaatcatgaagtctttgtcca

SEQ ID NO: 2211 - DNA, 700 bp, Homo sapiens
ttccttgtagattctggatattagccctttgtcagatggatagattgcaaacattttctcccattctgcaggttgcctgttcactctgacgatagtttttttttctgtgcagaagctctttagtttaattagatcccatttgtcaattttggcttttgttgccattacttttggtgttttaatcatgaagtctttgtccatgcctatgtcctgaatggtattgcctaggttttcttctggggtttttatgattttgcgttttccatttaagtctttaatccatcttgagttaatttttgtgtaaggtgtaaggaaggggctcagtttcagttttctgcatatagctagccaattttcccaacaccatttattaaatagggaatcgtttccccatttcttgtttttgtcaggtttgtcaaagatcagatggttgtacatatgtggtgttatttttgaggtctctgttctgttccattggtctatgtatctgttttggtaccactaccatgttttggttactatagccttgtagtatagtttgaagtcaggtagcatgatgcccccaactttgtactttttacttaggattgtcttggctatgcagtctttttttaggttccacatgaaagctaaagtagtttttaccaaatctgtgaagaaagtcaatggtaacttgatggggatagcactgaatctgtta

SEQ ID NO: 2212 - DNA, 700 bp, Homo sapiens
actaccatgttttggttactatagccttgtagtatagtttgaagtcaggtagcatgatgcccccaactttgtactttttacttaggattgtcttggctatgcagtctttttttaggttccacatgaaagctaaagtagtttttaccaaatctgtgaagaaagtcaatggtaacttgatggggatagcactgaatctgttaattactttgggcagtatgccattttcatgatattgattcttcctattcatgagcatagaatgtctttccatttgtttgtgtcctctcttattttcttgatcagtggtttgtagttcttgaagagatccttctcatcccttgtaagttgtattcctaggtattttattctctttgtagcaattttgactgggagttcacgcatgatttggttctctgtttgtctgttattggtgtataagaatccttgtgatttttgcacattgattttgtatcctgagactttgctgaagttgcttatcagcttaagaagattttgagctgagacaatgggattttctaaatatagaatcatgtcatctgtaaacagagacaatttgacttcctcttttcctgtttgaataccctttatttctttctcttgcccgattgccctggccagaacttccaatattattatgttgaataggagtggcgagagaggccatccttgtcttgtgctg

SEQ ID NO: 2213 - DNA, 700 bp, Homo sapiens
gcttaagaagattttgagctgagacaatgggattttctaaatatagaatcatgtcatctgtaaacagagacaatttgacttcctcttttcctgtttgaataccctttatttctttctcttgcccgattgccctggccagaacttccaatattattatgttgaataggagtggcgagagaggccatccttgtcttgtgctggttttcaaaggaaatgcttccagcttttgcccattcagtatgatattggctgtgggtttgtcataaatagctcttattattttgagatatgttccatgaatacctagtttattaagagtttttaacatgaagaggtgttgaattttgtcaaaggccttttctgcatctattgagataatcatgtggtttttgtcattggttctgtttatgtgatggattacacttatggatttgtgtatgttgaaccagccttgcatcccagaaatgaagccgagttgattgtggtggataacctttctgatgtgctgctagatttggtttgccagtattttattgagggttttcgcattgatgttcatcagggatattagcctgaaattttctgaataccaaagcctggcctgtctccaccaggttttggtatcaggatgatgctggcctcataaaatgagttaggggggattccctctttttctcttgtttggaatagtttcagaagg

SEQ ID NO: 2214 - DNA, 700 bp, Homo sapiens
atgtgctgctagatttggtttgccagtattttattgagggttttcgcattgatgttcatcagggatattagcctgaaattttctgaataccaaagcctggcctgtctccaccaggttttggtatcaggatgatgctggcctcataaaatgagttaggggggattccctctttttctcttgtttggaatagtttcagaaggaatagtaccagctcctctttgtacctctggtagaatttgtctgtgaatctgtctggtcctgggctttttttggttggtaggctattaattactgcctcaatttcagagcctgttattggtctattcagggatttgacttcttcctggtttagtcttgggtgggtgtatgtgtccaggaatttatccatttcttctcaattttctggtgtatttagatttctagtttatttgtattttcgtgggatcagtggggatatcctctttaccatgttttagcgtgtctatttgattcttctctcctttcttctttattagtctgactagcggtctatctattttattgatcttttcaaaaaaccacctcctggattcatggattttttgaagggtttttcatgtctctatctccttccaatctgctctgatcttagttatttcttgtcttctgctagcttttgaatttgtttactcttgcttctctagttttaattttgatgtta

SEQ ID NO: 2215 - DNA, 700 bp, Homo sapiens
tttcttctttattagtctgactagcggtctatctattttattgatcttttcaaaaaaccacctcctggattcatggattttttgaagggtttttcatgtctctatctccttccaatctgctctgatcttagttatttcttgtcttctgctagcttttgaatttgtttactcttgcttctctagttttaattttgatgttaggatggagattttagatatttcctgctttctcttgtgggcatttagtgctataaattttcctctaaacactgctttaaatgtgtcccagggattctgtacgttgtgtctttgttttcattggtttcaaagaacatcttcatttctgccttaatttcgttatttacccagtagtcattcaggagcaggttgttcagtttccatgtagttgtatggttttcagtgagtttcttaatcctgagtcctaatttgattgcactgtggtatcgagaaactgtttgttatgatttctgttcttttgcatttgctgaggagtgttttacttccaattatgtggtcaattttagaactagtgcaatgtggtgctgagaagaatgtataatttgttgatttggggtggagagttctgatgtcttttatgtccacttggtccagagctgagtttaagtcctgaatatccttgtgaatttactgtctcattgatccttctaatattgatggt

SEQ ID NO: 2216 - DNA, 700 bp, Homo sapiens
atttgctgaggagtgttttacttccaattatgtggtcaattttagaactagtgcaatgtggtgctgagaagaatgtataatttgttgatttggggtggagagttctgatgtcttttatgtccacttggtccagagctgagtttaagtcctgaatatccttgtgaatttactgtctcattgatccttctaatattgatggtggggtgttaaagtctcccattattattgtgtggcagtcttaagtctctttgtagatcttaagaacttgttttatgaatctgggtgctcttgtattgggtgcatatacatttaggatagttagcttttcttgttgcattgatccctttaccattatgtaatgcccttctttgtcttttttgatctttgttggtttaaagtatgttttattagagactaggattgcaactcctgctttttttgctttccatttgcttgataaatattcctccatccctttattttgagcctatgtgtgtcttttcacatgagatgggtctcctgaatacagcacactgatgggtcttgactcattacccaatttgccagtctgtcttttcactggggcatttagccagtttacatttaaggttaatattgttatgtgttaatttgatcctgtcattatgatactagctggttattttgcctgttagttgatgcagtttcttcatagtgtcaa

SEQ ID NO: 2217 - DNA, 700 bp, Homo sapiens
ttcacatgagatgggtctcctgaatacagcacactgatgggtcttgactcattacccaatttgccagtctgtcttttcactggggcatttagccagtttacatttaaggttaatattgttatgtgttaatttgatcctgtcattatgatactagctggttattttgcctgttagttgatgcagtttcttcatagtgtcaatgatctttacaatttggtatgtttttgcagtggctggtaccagttgttcctttccatgtttagtcttccttcaggagctctggtaaggcaggcctggtggtgacaacatactcagcatttgcttgtctctcaaggattttatttctccttcacttatgaaacttagtttggcttgatatgaaattctgggttgaaaaatcttttctttaagaatgttgaattttagccctgactctcttctggcttctagggtttctgcagagtgatctgctgttagtctgatgggcttccctttgtgggtaacccgacctttctctctggctgcccttaacattttttccttcatttcaaccttggtgaatctaatgattatgtgtcttggagttgctcttctcaaggagtatctttgtggtgttctctgtatttcctgaattttaatgttgacctgtcttgctaggttggggaagttctcctggataatatcctgaagtgtgttttcc

SEQ ID NO: 2218 - DNA, 700 bp, Homo sapiens
taacccgacctttctctctggctgcccttaacattttttccttcatttcaaccttggtgaatctaatgattatgtgtcttggagttgctcttctcaaggagtatctttgtggtgttctctgtatttcctgaattttaatgttgacctgtcttgctaggttggggaagttctcctggataatatcctgaagtgtgttttccaacttggttccattctccccattactttcaggtacaccaatcaaacataggtttggtcctttcacatagtcccatatttctcggaggctttgttcgttcctttttattcttttttctccgatcttgtcttctcgctttatttcgttaagttgatctccaatttctaatatcctttcttctgcttgactgattcagctattgatacttgtgtatgcctcatgaagttcttgtgctgtgtttttcagctccatcacgttatgttcttctctaaactggttattctagtcagcaattcatctaaccttttttcaaggttcttagcttccttgcattgggttagaacatgctcctttagctcagatgagtttgttattacccaccttctgaaacctacttttgtcaattcatcgaactcattctctttccagtttttttctcttgctggcgaggagttgtgatgctttggagaagaggttttttggtttttggaattttcagcg

SEQ ID NO: 2219 - DNA, 700 bp, Homo sapiens
accttttttcaaggttcttagcttccttgcattgggttagaacatgctcctttagctcagatgagtttgttattacccaccttctgaaacctacttttgtcaattcatcgaactcattctctttccagtttttttctcttgctggcgaggagttgtgatgctttggagaagaggttttttggtttttggaattttcagcgtttttgcactggtttctccccatctttgtggatttatctacctttggtctttgatgtaggtgaccttcggatggggtctctgttagttttccttctaatagtcagggccctctgctgcaggtctgctgtagtttgctggaagtccattccagatcctgttttcctgggtatcaccagtggaggctgcagaacagcaaagattgctgcctcttcctttgggaagcttcatcccagaagggcacctgccagatgccagccagagctctcctgtatgaggtgtctgttggcccctactgggaggtttctcccagttaggatatatggaggtcagggagccagttgaagaggcagtctcacccttagcaaagctcaaatgctgtgctgggagatctgtgctcttcagagctgtcaggcagggacttttaagtctgatgaagctgcacccacagccgcctcttcctccaggtgctctgtcccagggagatgggggttttatctgt

SEQ ID NO: 2220 - DNA, 700 bp, Homo sapiens
gtttctcccagttaggatatatggaggtcagggagccagttgaagaggcagtctcacccttagcaaagctcaaatgctgtgctgggagatctgtgctcttcagagctgtcaggcagggacttttaagtctgatgaagctgcacccacagccgcctcttcctccaggtgctctgtcccagggagatgggggttttatctgtaagcccctgattggggctgctgcctttttttcagaggtgccttgcccagggaggaggaatctagagaggcagtctggccacagtggccttgctgagctgcagtgggctccacccagtttgaacttccaggtggctttgtttacactgtgagggtaaaaccacctactcaagcctcagcaatggcggatgcccctccccccaccaagctcaagcatcccaagttgacctcagactgctgtgctggcagcgagaatttcaaggcagtggatcttagcttgctgggctccatggaggtgagacccaccaagcccaaccacttggcttcctggcttcagccccctttccaggggagtgaatggttctgtctcgctggcattccaggtgccactggggtatggaaaaaaaaaagtcctgcagctaactcagtgtctcctgaatggctgcccagttttgtgcttgaaacccagggccctggtggtataggcacgtggtctgggggt

SEQ ID NO: 2221 - DNA, 700 bp, Homo sapiens
ccaccaagcccaaccacttggcttcctggcttcagccccctttccaggggagtgaatggttctgtctcgctggcattccaggtgccactggggtatggaaaaaaaaaagtcctgcagctaactcagtgtctcctgaatggctgcccagttttgtgcttgaaacccagggccctggtggtataggcacgtggtctgggggttgtgaagaccgtgggaaaagtgcagtatctgggccagagtacactgttcctcaggctcagcccctcacagcttcccttgggtaggggagataattccctgaccccttgcgtttcctgggtgaggcgatgccccaactgcttccgctcgccctccgtgggctgcacccactgtccacccagtcccagtgagatgaaccaggtacctcagttggaaatgcagaaatcacccaccttctgcatcgatcttgctgggagctgcagaccggagctgttcctattcagccatcttgccaactctctcttaagaattttttactataatctatttcatatgttctactgtatacaatgccaattgatgtttgcttttatttatttgcaatttagtgactttaaaaaattgagatttttgtaaaagaatatttctgttcttatagcattgcagtcaaagaatatgggcaataaaatttctgctttgagaaatttgctgaggttgtttt

SEQ ID NO: 2222 - DNA, 700 bp, Homo sapiens
cttaagaattttttactataatctatttcatatgttctactgtatacaatgccaattgatgtttgcttttatttatttgcaatttagtgactttaaaaaattgagatttttgtaaaagaatatttctgttcttatagcattgcagtcaaagaatatgggcaataaaatttctgctttgagaaatttgctgaggttgtttttatgactttttaagagtaatgtatagccaatgtttatgggctatagtgtttaatgtctctcttaagccaagtttattaattattaataatagtcaatttctcttcttcatgaaagaaatacgttcacgatgttcattattatcatggttttatcagttttatcttgaattttctttattccttgttgttttggttattttgtaaactgttattcagcccagaaattgttacgaatgtttgtcttcattctgtattatcatagcaaaatagtcctctgatttcattgtctattactgcttctgatttcttattttatgtatttttgcccatctattttaatccatttgcttgtgtctatatccactgctaaaacccaagtccacgtttactgtgatccattttctagactattgacataggttcctacttggtgttcttgcctcgtcttttaccaacaacaatttattgttcacccagcagccaaagggaatattttccag

SEQ ID NO: 2223 - DNA, 700 bp, Homo sapiens
tgatttcttattttatgtatttttgcccatctattttaatccatttgcttgtgtctatatccactgctaaaacccaagtccacgtttactgtgatccattttctagactattgacataggttcctacttggtgttcttgcctcgtcttttaccaacaacaatttattgttcacccagcagccaaagggaatattttccagccaaaagccctctcatgacttccctcacacttatgcttcttatcatgccttatgtatatatgtataagcagcccacagcatacttctccaccctcatctcctactgctctcctctttgctcactgtgctctagacatactgaccttatttctcctccttaactatgctatatgtttccctcagggcctttgcggtagctagtatctgtacctagagggctccttttcatgatgaatgcttttttttcattgatgactaagtacacttgtcacctcttcagagaattcttccctgacacctaaagtagccattccatcactaagtcattcttatgttttattttttcttcaaagcatttatcaatatctgaaatattcttgattgtttattcttttactcagtaaaagcgattaccttgtatgagttgttgactgttatattgctgacatctgtgaccctgcacatctcaagcaagtgacgtgggagtgggagttgtgata

SEQ ID NO: 2224 - DNA, 700 bp, Homo sapiens
aaagtagccattccatcactaagtcattcttatgttttattttttcttcaaagcatttatcaatatctgaaatattcttgattgtttattcttttactcagtaaaagcgattaccttgtatgagttgttgactgttatattgctgacatctgtgaccctgcacatctcaagcaagtgacgtgggagtgggagttgtgataaagtcaagagtcaggcctgatatagagaattgtctgtcattaaaaggaggttttccaaccttggagagtcagaggaaatggagactggcctagctatgtctgaaggtgaaataaatatatttataaactagagccacctctcagttatctgtatgatcccaggcagaaacacttagcatggtttctgatacagagttggtactcagaatgcatttcttgaaatgaatcaaagtatactgactgattgctgtatgcctctgtcctaggtgctatgggaaattcagggataataaaagcacagcccatcctacaaggatgctacatctagcaggggatattagccatttgaagagttaaataataaccacagatttctcaagaaatctagatgtgctgaaagaagggagggcttcctcccaactggatagttggggaaggtttccaaaaagggacaatattagctacatcttgaagaagtggttggaaaaaggaaggatgtg

SEQ ID NO: 2225 - DNA, 700 bp, Homo sapiens
gcccatcctacaaggatgctacatctagcaggggatattagccatttgaagagttaaataataaccacagatttctcaagaaatctagatgtgctgaaagaagggagggcttcctcccaactggatagttggggaaggtttccaaaaagggacaatattagctacatcttgaagaagtggttggaaaaaggaaggatgtggtttgggtggactagagagtgggagtaactgataaagatgttgtagaggccctaatgagcatgacgtgtgggagaagtaaaagggttcatttggggtagaaaaggcatacagggcatagagtacttaggtcctgacccagtgagcattcatcttgattgctaagcttaggatttgggcctttacgttgtggctacaggaaggtattggaagcctttgagccaggaagaaagaattatagttagaagtgcttcaagaagttctattctgcattaagacaagggccattaaaaaaaaaaaaaaaaactccattgatgcaagatgtctccttttgtctttttctgcctttaccccatctgcctccccccacccccaccctctctcaatgtggtctcactctcacccaggctggagtgcagtggtgtgatcacagctcattatagcctcaaactcctgggctcaagcagtctttcctcctcagcctcccaagtagttacaacta

SEQ ID NO: 2226 - DNA, 700 bp, Homo sapiens
aaaactccattgatgcaagatgtctccttttgtctttttctgcctttaccccatctgcctccccccacccccaccctctctcaatgtggtctcactctcacccaggctggagtgcagtggtgtgatcacagctcattatagcctcaaactcctgggctcaagcagtctttcctcctcagcctcccaagtagttacaactacaggtacatgtcaccatgcccggctaattattaaaagttttttcttgtagagacaaggtctcactatgtcacccagcctggtttaaactcctggcctcaagtgatcctcctgcctcagcctcccaaagcactagtattacattcatgagccactgctcccagcttgccttttctctatttcttcccttcccccaacctggatcagcctcctgggatattccctggagtgacctctgattactaccatccccaaagcagtaacaaggtcagcatcagacagtttatttgctagtggctactgcagtctgaaccctggctagcatgtcagatatggcagagatattagagttttccaaaggggaattctgcatcctggatacctgaaatagagactatgtttggggataagtagactactttgatgccttcagtgttgaactcatggggttctgggtagccaggggcattatccaacatcaaaaaagcttttaaaggcaatc

SEQ ID NO: 2227 - DNA, 700 bp, Homo sapiens
gcagtctgaaccctggctagcatgtcagatatggcagagatattagagttttccaaaggggaattctgcatcctggatacctgaaatagagactatgtttggggataagtagactactttgatgccttcagtgttgaactcatggggttctgggtagccaggggcattatccaacatcaaaaaagcttttaaaggcaatcccttactcacaaggtacttcctgacctcagggacaaagcattgatggaaccaatacagaaaaaggattttcatcatccaggccttcttctacagctgaaagactggcagctggtatacaactgttccctgcaaggattgggagttagcagctttatggataagggcaatgctagtgcttgcttctgttccttactaataaatatcgtttgtgacactttttttcagaatagggcatttttgtctgtattaaaaacctgttgaggcaggtatcctttgtcctcaattattttcttaatgatacctgggaacctatctcctgcctttggtcagcagaaactgcttctcctattaccttgatatttttaaggccaaacctcttgctaaaattatcaaaccatcctttgctggcattaaatttttcagctttagctccttcaccttcctatttgtttgtttatttatttaagacagaatctcgctctgtctcccaggctggagt

SEQ ID NO: 2228 - DNA, 700 bp, Homo sapiens
acctgggaacctatctcctgcctttggtcagcagaaactgcttctcctattaccttgatatttttaaggccaaacctcttgctaaaattatcaaaccatcctttgctggcattaaatttttcagctttagctccttcaccttcctatttgtttgtttatttatttaagacagaatctcgctctgtctcccaggctggagtgcagtggtgcaatcttggctaactgcaacttccacctcccaggttcaagtgattcttgtgctgcatcctcctgaatacctgggattacaggcatgtgccacaatgcccagctaatttttgtatttttagtagagatggggtttcaccatgttggccaggcaggtctcaaactccctcctgacctcaggtgatcaggccgcttcgacctcccaaagtgttgggattacagccatgagccagtgtacctggcctcttcaccttccttttggtttatgttgtcatataatgactctgctttttctcaagtcacagtagggtctatagttatacctttcttctagcaatcctctacccacataaagctgcaatttcaatatgagataaaaagatatttcacaaaaaaatgcaaggtttttggacatggtgacatagctgtggtgatggcttcataaatttcattttcttttttaacaatggtccttacactagattcatttatc

SEQ ID NO: 2229 - DNA, 700 bp, Homo sapiens
ctcaagtcacagtagggtctatagttatacctttcttctagcaatcctctacccacataaagctgcaatttcaatatgagataaaaagatatttcacaaaaaaatgcaaggtttttggacatggtgacatagctgtggtgatggcttcataaatttcattttcttttttaacaatggtccttacactagattcatttatcttgaaatggtggacacactgcagctgcagacctcaatgtacagtacatattaatggattcagtttttcttaatgtcatgacttttctttgcttcttgggagcactttccagcatggttggaaagttgaggcctctttcaactcatcactctttcttcctgggtccctctctatggaaaacaggtaagtcaaatttcaaaactgtgcactatggttccaaccatagtttcctttggccacttgccaaagtgggacttctcactaatgggagtaaaaatgaaggttttatccagattatcagtaggatcacactgttctgtcattcggtttgctagacttgtttcatataactcagtttcaccaatatagcacctttccttgggcttttctgaaaatatcacttgtacaagatttttgtgtgtgagcagattcgtgagaagacttgcggtgccaaatgtgttttatgttgccatggtgcttgctcttagcttcatctgtcat

SEQ ID NO: 2230 - DNA, 700 bp, Homo sapiens
taggatcacactgttctgtcattcggtttgctagacttgtttcatataactcagtttcaccaatatagcacctttccttgggcttttctgaaaatatcacttgtacaagatttttgtgtgtgagcagattcgtgagaagacttgcggtgccaaatgtgttttatgttgccatggtgcttgctcttagcttcatctgtcatgagggttttgtttctcatagtagtgttttctcctaccaaattccactacacatcctctcctaccctttggtaaaccctgccccaaacaaacagagcaattaatctagaactgtgttgtccagtacagtagccattagccatatatggctatttaattaaatatggccaattaattaaaattaaataaaattagaaatttaaaactctcagttgccgtaaccatatttcaggtgttcaatagccacatgtgctagtagcttctacattggacagtgcagatatacaacattctgattaccacagaaagttctattggataatgctaatctagaataatactgccaaattccagcaggactatcaaggtagatgtaagtactccaaggcacattcctatcacgttccctgttgccactatagaaagtataacttcttcattattccagttgcccatctggtaactattagatcaggcacacgtgcacatgcacgcacacaca

SEQ ID NO: 2231 - DNA, 700 bp, Homo sapiens
cagaaagttctattggataatgctaatctagaataatactgccaaattccagcaggactatcaaggtagatgtaagtactccaaggcacattcctatcacgttccctgttgccactatagaaagtataacttcttcattattccagttgcccatctggtaactattagatcaggcacacgtgcacatgcacgcacacacacacacacagacacacacacacacacattaattcttacagactggatattctaaatttacaagaaggaggaaaagcattttcctaattgctccaaaattttctctacccataataaagcgagtaccttacattattttgcaaagaagtccctcactttcaaattgtgcccccttgggcctggcataaataagaaaacaaacccatttttgaagctatctcatttaatgaaaggtcattcagctataaaaggatgcaaagaaagtttttcttatctattccttttaagaccctaattatgttctcacctattccccagttcctgctgagtctctgaaggtaggagtgggaagtcttgcattggaaaggccttcttaggtgcagtagtatttgttattttacaccttaacctcaaaggaagtccttctttttcttgggatggagcactttagttctcataactcttctctgaagtcattgcagagtgggtggaggaaggtgag

SEQ ID NO: 2232 - DNA, 700 bp, Homo sapiens
ctcacctattccccagttcctgctgagtctctgaaggtaggagtgggaagtcttgcattggaaaggccttcttaggtgcagtagtatttgttattttacaccttaacctcaaaggaagtccttctttttcttgggatggagcactttagttctcataactcttctctgaagtcattgcagagtgggtggaggaaggtgagggtgatgctttggtctgaattttcttggtaaacttacaagtggatctatcaaaaccagagggttttttcttaaccacaccacccccagaattccatttcctgcagatgtagcagcagcacgtctagccatcttggcccaggcctctggaccatgccttgggagggctctgccctctgccttgagttccattagaacttctccagtggaaagagtgagttactttgccctggcctggtgggcaggctttttcctctctgacttggctaaatgaaatgggatttaaggtagctctccctgtgggtaaaagacattttgctctatgctagagaaaaagggaggtagtggtttcatctgccactactacctatggatgtgaacagaacctctgctcctgatgcagacccctggccctttcccagctcctattctgttttgacttctgcacacccctttttctgaccctgatactatcccagatcattattcttcctctagtcct

SEQ ID NO: 2233 - DNA, 700 bp, Homo sapiens
ggtaaaagacattttgctctatgctagagaaaaagggaggtagtggtttcatctgccactactacctatggatgtgaacagaacctctgctcctgatgcagacccctggccctttcccagctcctattctgttttgacttctgcacacccctttttctgaccctgatactatcccagatcattattcttcctctagtcctacccttgttctagccagtgccccagacccaaggtgagctaagggacagtctctcaaagtctgggcagagagcctcaggaagttggggtatggctgagagaagaggggagtgcagggggataggcatacagactctgaatgcttgaccttccttattttctgtctttgaacttatttcaacagaggaacccttatcatctagccctgtggctctctagtaccttgtacctgcttcctgtcccataattgtgagcgtttagctgtggtgcaggtgagagacccattctcccaccctcaggagccaggaaggcccaccagtatggcagggaggcctaggcagagatatacaggagagcagagacgtctggagctaggtcaccggtggtcagcagggcctcctgcagagggagcagcctcctttggcctttgcttgtctgacttctaatgatcctgtaaaaattagttttgttttttaagcaccccaatgatgcatgaatacac

SEQ ID NO: 2234 - DNA, 700 bp, Homo sapiens
ccaggaaggcccaccagtatggcagggaggcctaggcagagatatacaggagagcagagacgtctggagctaggtcaccggtggtcagcagggcctcctgcagagggagcagcctcctttggcctttgcttgtctgacttctaatgatcctgtaaaaattagttttgttttttaagcaccccaatgatgcatgaatacactcttttgtcaaatcttaaaaagagaaaatccttttttttttttaaataaaaaagaaagttatttagtcttaagattgtaaaactgtaaagttaaataaagtggccgccctttggctgccctgatccccatcccctactccagcttctgcaagtaaccacaattctcagctaggtgtatatccttccagacgtctttctatacatttacttttccttattgtttaaaccaatttgagttgtcttttctcttacttaaatctgaaagtgttcctaaccaatttaataacaattgcctcagagctgtttattgaaaggttcttcgtttcatactgacataaaacgccagttgtgttagaccctggccaggcctgcttcctcaaagacccagagtaaacatgaactgtaaactccaaaactgtacaactagtttttaaagaaagattgcccaagatactggcacaagactttttaaggcctaggatttgcatattagacctatg

SEQ ID NO: 2235 - DNA, 700 bp, Homo sapiens
ctgtttattgaaaggttcttcgtttcatactgacataaaacgccagttgtgttagaccctggccaggcctgcttcctcaaagacccagagtaaacatgaactgtaaactccaaaactgtacaactagtttttaaagaaagattgcccaagatactggcacaagactttttaaggcctaggatttgcatattagacctatgtaatgtggcttactgaagagcagagttcttgctttctttggtagtgtaagctctttctggtgctcacacaggaaggactgtaaagggcagtgagggctcgaatctggactcttctgacatgagggacatctcattttatgcaggctgccaagaccattgaacttggaggatgcctttgtgagaaagcaagaaaggcagtggggagctgcagcccccacatgcaccttcatctcaggaacatcctttgtacttttttttttaatattgtacagagctgtttttttttattatactttaagttttagggtacatgtgcacaacatgcaggttagttacatatgtatacatgtgccatgttggtgtgctgcacccattaactcgtcatttaacattaggtatatctcctaatgctatccctccccgctcccccccaccacaacagccccagtgtgtgatgttccccttcctgtgaccatgtgttctcattgttcagttcccac

SEQ ID NO: 2236 - DNA, 700 bp, Homo sapiens
  misc_feature (1)...(700): n = A,T,C or G
tttagggtacatgtgcacaacatgcaggttagttacatatgtatacatgtgccatgttggtgtgctgcacccattaactcgtcatttaacattaggtatatctcctaatgctatccctccccgctcccccccaccacaacagccccagtgtgtgatgttccccttcctgtgaccatgtgttctcattgttcagttcccacctatgagtgagaacatacggtgtttggttttttgtccttgcgatnntttgctnagaatgatggtttccagcttcatccatgtccctacaaaggacatgaactcatccttttttatggctgcatagtattccatggnntatatgtgccacattttcttaatccagtcnatcattgttggacatttgggttgnttccaagtctttgctattgtgantagtgccacantaaacatacgtgtgcatgtgtctttatagcagnatgatttataatcctttgggtatatacccagtaatgggatggctgggtcaaatggtatttctagttcnagatccntgagnaatcnccacactgncttccacaatggttgaactantttacantnccaccaacagtgtaaaantgttcctatttcnccacatccncnccagcacctgttgtttcctnacttttnaatnancacnnttnnaactggtgtgagatggtatctcattgtggttttg

SEQ ID NO: 2237 - DNA, 700 bp, Homo sapiens
  misc_feature (1)...(700): n = A,T,C or G
ctgggtcaaatggtatttctagttcnagatccntgagnaatcnccacactgncttccacaatggttgaactantttacantnccaccaacagtgtaaaantgttcctatttcnccacatccncnccagcacctgttgtttcctnacttttnaatnancacnnttnnaactggtgtgagatggtatctcattgtggttttgatttgcatttctctgatgccagtgatgatgagcatttttcatgtgtcttttggctgtgtaaatatcttcttttgagaagtgtctgttcatatccttcgcccactttttgatgggttttttttcttgtaaatttgagttcattgtagattctggatattagccctttgtcagatgaatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtattgcctaggttttcttctagggtttttatggtttcaggtctaacatgtaagtctttaatccatcttgaattaatttttgtataaggtgtaaggaagggatccagtttcagctttctacatatggctagccagttttcccagcac

SEQ ID NO: 2238 - DNA, 700 bp, Homo sapiens
ttgcttttggtgttttagacatgaagtccttgcccatgtctatgtcctgaatggtattgcctaggttttcttctagggtttttatggtttcaggtctaacatgtaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcaggtcgttgtagatatgcggcattatttctgagggctctgttcggttccattggtctatatctctgttttggtaccagtaccatgctgttttggttactgtagccttgtagtatagttagaagtgaggtagcatgatgctccagctttgtttttttggcttaggattgactctgcaatgtgggctcttttttggttccatatgaacttgaaagtagttttttccaattctgtgaagaaagtcattggtagcttgatggggatggcattgaatctataaattaccttgggcagtatggccattttcatgatattggttcttcctacccatgagcatggaatgttcttccgtttgtttgtatcctcttttatttcattgagcagtggttagtagttctccttgaagaggtccttcatgtcccttgtaagttggattcctagg

SEQ ID NO: 2239 - DNA, 700 bp, Homo sapiens
tcattggtagcttgatggggatggcattgaatctataaattaccttgggcagtatggccattttcatgatattggttcttcctacccatgagcatggaatgttcttccgtttgtttgtatcctcttttatttcattgagcagtggttagtagttctccttgaagaggtccttcatgtcccttgtaagttggattcctaggtattttattctctttgaagcaattgtgaatgggagttcactcattgtttggctctctgtttgtgtgttattggtgtataagaatgcttgtgatttttgtacattgattttgtatcctgagactttgctgaagttgcttatcagcttaaggagattttgggctgagacaatggggttttctagatatacaatcatgtcacctgcaaacagggacaatttcacttcctcttttcctaaatgaataccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttc

SEQ ID NO: 2240 - DNA, 700 bp, Homo sapiens
aataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctgttgagataatcatattgtttttgtcattggttctgtttatatgctggattacatttattgattttcatatgttgaaccagccttgcatcctagggatgaagcccacttgatcatggtggataagctttttgatgtgctactggatttgatttgccagtattttattgaggatttttgcatcgatgttcatcagggatattggtctaaaattctctttttttgttgtgtctctgccaggctttggtgtcaggatgatgctggcctcataaaatgagttagggaggattccctctttttctattgattggaatagtttcagaaggaatggtaccagctcctccttgtacctctggtggaattcggctgtgaatccatctggtcctggactttttttgtttggtaagctattaattactgcctcaatttcagagcctgttattggtctattcagagattcagcttcttcctggtttagtcttgggagagtgtatg

SEQ ID NO: 2241 - DNA, 700 bp, Homo sapiens
tttttctattgattggaatagtttcagaaggaatggtaccagctcctccttgtacctctggtggaattcggctgtgaatccatctggtcctggactttttttgtttggtaagctattaattactgcctcaatttcagagcctgttattggtctattcagagattcagcttcttcctggtttagtcttgggagagtgtatgtgtcgaggaatttatccatttcttccagattttctagtttatttgcatagaggtgtttatagtattctctctcttttttttttttttttttttttgagacagagtctcactctgtcacccaggctgtagagcagtggtgcaatcttggctcattgaaacctccacctcccaggttcaagcaattcttgtgcctcagcctctggagtagctgagattacaggcacacactcccatgcccggataatttttttttttttttttttttttaagtagagatggggtttcaccatgttggccaggctgatctcgaactcctgatctcaagtgatctgcctgtctcccaaagtgctgggattacaagcatgagccactgcgcctggccggtttctggtataattcttgatcttattaaggatgcttcctagtagtcctagtagacaaagaatttttctcataaacggatgtttctgttgagatgatcatctttagattaaccaatt

SEQ ID NO: 2242 - DNA, 700 bp, Homo sapiens
ctgatctcgaactcctgatctcaagtgatctgcctgtctcccaaagtgctgggattacaagcatgagccactgcgcctggccggtttctggtataattcttgatcttattaaggatgcttcctagtagtcctagtagacaaagaatttttctcataaacggatgtttctgttgagatgatcatctttagattaaccaattattgtggagaagtacattggtagattttccataatcaaatttgcattcctgggaatgaccctgcttgatcatgatctgttattcttttaattcaatttggtaatgtcttattcctactgagttctacctcagtaaaaattttcaccaaaactgtgcctagcctccaggctgggtggcatgttccttctctatgcaccgagagcaccatgtctgtctttttctaatacctctctagttttgtacttacaatctggtattataattacatgtctccctcagtggaatatgccattgttgagagacagacttttgtcttcttcctaattgtatcctcagtgcccagataaggcctgatttaaagcaggcctttggaaaatatgtctagtctgtgcgaaaatgcttaccattcccctgacagggacaagtgccaagtccccatactagtttagctttgtgcgcagagccctggccttgttggtccagcttatcatgcagacaag

SEQ ID NO: 2243 - DNA, 700 bp, Homo sapiens
gacagacttttgtcttcttcctaattgtatcctcagtgcccagataaggcctgatttaaagcaggcctttggaaaatatgtctagtctgtgcgaaaatgcttaccattcccctgacagggacaagtgccaagtccccatactagtttagctttgtgcgcagagccctggccttgttggtccagcttatcatgcagacaagagccatgtcaatactggtggaccccgcttgctgtgggagctggagagccagatatgctcacagctccttctcagttacacctaagctgcctgtggggagctcaggactctgcatgcgcctccacatcttcaggccgaagattctccatcacttccaagaaagcacgctcaaatgtgaaagcagataaatcattagcaccctgtgctggggcttgttactgttcaacaggggttctctttctgggaacctaagatacttcatgtgtaccttagcagcagctaatgggggtggatggaagtggtcaccaggcattccagtcacccagggatgcctaggtccctttaccaggaagcagcgagagaggcataatggacacaactctgtctttcttatagaagacacctgtttcaggccaggcctttatcttgctgaagctgaccccactgaagggtcattgtgctttggttagaaaaccactgcaaccaaagccatccagtgac

SEQ ID NO: 2244 - DNA, 700 bp, Homo sapiens
  misc_feature (1)...(700): n = A,T,C or G
gtcaccaggcattccagtcacccagggatgcctaggtccctttaccaggaagcagcgagagaggcataatggacacaactctgtctttcttatagaagacacctgtttcaggccaggcctttatcttgctgaagctgaccccactgaagggtcattgtgctttggttagaaaaccactgcaaccaaagccatccagtgacaaagtagtgggatccctcatactggagcaggcagacacctactgtcccagtagtctcatgtcagaaacaacactcaacatacattgtcttttgtgcccagcttgggagctggtctgtgaggactgagggatcccaggtaccttgagttcttgtaaccatacagtggatggacacagacacagcaccatcctagggctggcagatactccatgctcatcggtgccagcctgctcatcaacagaatcacccacctccattctgtcacccaccaggtatttactgagactcttctacatgacatgtgccattgagggtactgggagaatagcagcagacntataatacaaaagcccctgcccttgaggggggctacctggtttccaggtgcacccccagtttatctcatggtttaggtggcactatttatgactcaccaagtttgtgacagatgatcagtgtcttccttctgtggctgcagtttatctgtgcacagatgctgg

SEQ ID NO: 2245 - DNA, 700 bp, Homo sapiens
  misc_feature (1)...(700): n = A,T,C or G
tgtgccattgagggtactgggagaatagcagcagacntataatacaaaagcccctgcccttgaggggggctacctggtttccaggtgcacccccagtttatctcatggtttaggtggcactatttatgactcaccaagtttgtgacagatgatcagtgtcttccttctgtggctgcagtttatctgtgcacagatgctggcatccttcaatccaggtctcaggtttgggtcagggcttagcttgaggcagtaggaagaacagagctctctggatggtttaggcaagcttgtccaacccatgactcacaggctgtatactacccatgacagctttgaatgtgacccaacataaattggtaaactttcctaaaacattatgagattttttgctttctttttttttttttttttttttttttgctcatcagctattgttagtgttagtgaattttatgtgtggcccaagacaattcttcttccaaagtggcccagggaaaccaaaagattggacatctctggtttagagattcagttggtttcttcaacttcagttcttggtgtacagggatggcctctgacttgctccacatcctcaatccggccaccacctggttttctgcacacaggaaacacttggcaatgttggctgaaacaatgagtgagagccaagtgccaagtgctgggctaacctcgctcacag

SEQ ID NO: 2246 - DNA, 700 bp, Homo sapiens
aaagattggacatctctggtttagagattcagttggtttcttcaacttcagttcttggtgtacagggatggcctctgacttgctccacatcctcaatccggccaccacctggttttctgcacacaggaaacacttggcaatgttggctgaaacaatgagtgagagccaagtgccaagtgctgggctaacctcgctcacagccaattaggcataaagtaaccagggctgtaagagaagtggaaacagagatgcagatgctccaaggaggccagacacttgccctcctctcttggtgagtcctgtgctcagaaggggcacaacggagacgtgcttgggctgtccatacggcagtctctctgcggcagtggagaaagctctggtctgtgtgtatagtgtgcatgcaggggagtgtgcatatgtgtgtatatttgcctacatgcacatgcatgttcacattggctctggtccccacaacaacaccattatagggccctgcttagccatcctttctgcagtgggggggggggaggggaaaggggttcctgactgctgtgtcacttttggatagtcactgttttttgtgtgcagcactcctacctcacctaccccacccctagaggcaggcagggtgatgactgaagcatcaggcctgtggtttctgtaacaggaagtgatttagatgctgaaagctaattttaga

SEQ ID NO: 2247 - DNA, 700 bp, Homo sapiens
  misc_feature (1)...(700): n = A,T,C or G
ccatcctttctgcagtgggggggggggaggggaaaggggttcctgactgctgtgtcacttttggatagtcactgttttttgtgtgcagcactcctacctcacctaccccacccctagaggcaggcagggtgatgactgaagcatcaggcctgtggtttctgtaacaggaagtgatttagatgctgaaagctaattttagatgaaatgatatggggtttttaaagaatctttcagggttggtttcaggctcaaggcttagccccctgctcctcttgcctacaggggacaggcagtttcccattgtccttgtcactgtctngctgggtgaactcatgcctagctgggcagggttcttaggtagaaagccagtgctgatttttcctggatttcagaatgtttaagtcattgtttttggccttgaacaccagagtcctgtgactcagcacaggcctggctctaggccaagcagacacaggacctcttatccctggaangggactgcctggaggctcccaaggatcttgttaggacagagatgtccaccctcacccaggctgaggcctgggccagaggtcagatgaggcttctgggccaaaaaaagtatcatcttgggtggcagacacttaggtggggcctcttctcccagttagccctgtcctgagcctcttagcaggggcggctttctgacccaggtgccaca

SEQ ID NO: 2248 - DNA, 700 bp, Homo sapiens
gcctggaggctcccaaggatcttgttaggacagagatgtccaccctcacccaggctgaggcctgggccagaggtcagatgaggcttctgggccaaaaaaagtatcatcttgggtggcagacacttaggtggggcctcttctcccagttagccctgtcctgagcctcttagcaggggcggctttctgacccaggtgccacactaaggatcccatcctgattgagccctgtagattgggactcctgatagcagcagacacaaaagaaactgaggagtaggcacagaactctgagagtcctgtcctcctggtgtcggggtcccactggttggggaccttggagcctcatggtttctgtctctgccaaggcctgagcacaggaaatagaaggttgggcctccctggtcacctctgcaagggtcttcaaagcccattttaatctgttgtcccattccctaggtcttccacagcacccctataccagagaatgctgctcccattatcagagaagcagccaaatatcagcatgctaagagagatgtcccagggttacatagcttcactcaggcagcattggagccagccaggccaggagcttaccctgtcccatactaccgatgggatgcccagcattcagggaaaagagctcactctgcatatctcatctagacagcagccagcctcatgaacccctaccacaaac

SEQ ID NO: 2249 - DNA, 700 bp, Homo sapiens
cagagaagcagccaaatatcagcatgctaagagagatgtcccagggttacatagcttcactcaggcagcattggagccagccaggccaggagcttaccctgtcccatactaccgatgggatgcccagcattcagggaaaagagctcactctgcatatctcatctagacagcagccagcctcatgaacccctaccacaaacctgggacctctggaaagccaagtataagtctctgccagttcttagtccacccttgttctgctttgtggtgaggtatagcttgggagatgaggcgaggcctataggtcttggttggtacacaagaagaaacacttctgcctagagaggctgtcgacagacatttccagggacacacagcagacagccttcatggccttcatgaccagtcggtcccttgtggaagacaagtaggacaggacagatgattagcccagagccaaaactgagctcaaaccgcagaagaggagagcattctcacaaaagctccagtgtttgcagcacaatgacggaggtagatggtgtgagctaagccctgttttgagagttccatagaaggtgtctttgacctattttcaagggctgtggtggtaggaggaatttttggccacatcataaagagttttgtggccacctctgatatacctagctcaggaagttgtaattttccatgattaggttat

SEQ ID NO: 2250 - DNA, 700 bp, Homo sapiens
aagctccagtgtttgcagcacaatgacggaggtagatggtgtgagctaagccctgttttgagagttccatagaaggtgtctttgacctattttcaagggctgtggtggtaggaggaatttttggccacatcataaagagttttgtggccacctctgatatacctagctcaggaagttgtaattttccatgattaggttattagtcaccaaagtgattgctgcccccagaccctggcccctgtgctgcaggaggctgacagagatgcccctccagcactgcagccctgcctccccagctgcaggccagaagccaaggaggccctgagtactgatgttgggccctctgggtgcttcccttgtttgtggaaccccacagccccattccaacttcttgagcactttgcctaccccaggagatttaactggggcaagaaatcctgtaagatctcaacaaacggacgtgggtagaatagctcccagaaaatctactcaagggaagacccatgtactccaaggtatcaataatggtgagggactcagtctgtaactttctaggacagtttcatttcattttaaaaatttaagatgaaagaatttattaatggaagtagttcatgaagcactttcaggaaaccacacaggactcagagctccttgcctttagaaagacaggactgtgtcagcctgtgtggcattcaca

SEQ ID NO: 2251 - DNA, 700 bp, Homo sapiens
  misc_feature (1)...(700): n = A,T,C or G
cccatgtactccaaggtatcaataatggtgagggactcagtctgtaactttctaggacagtttcatttcattttaaaaatttaagatgaaagaatttattaatggaagtagttcatgaagcactttcaggaaaccacacaggactcagagctccttgcctttagaaagacaggactgtgtcagcctgtgtggcattcacacctggattcccagggtgggcttcccttagaaagggagaattagttgcagcccatctctctgtgggaatctcacctggtgagccccttctcccaaactcctagagtgtctcaccccagctcctgggctcgactggtgcctctgaggagcgtacctgctgttggaattggcggagcgctgccaggctgaggagcgaggagagcctgcccctgggccctgccaccaaagccatgggggcagtcgcatgctttgcttgtcagttggtggcatttaggtggcattaggaatgtttgttgtttctaattatttgtttgtttgtttgtttatttgaaagtaatccctctttttccaaaggcctgcatgctgccttgattctggaggagccagggattggcccaatgacccaaatgtttggaagtctttaagggcccttttcatgcccgtgaagtcacagaagtaggtaatcacccacctaccctccccaggtacccgatatngatgt

SEQ ID NO: 2252 - DNA, 700 bp, Homo sapiens
  misc_feature (1)...(700): n = A,T,C or G
attatttgtttgtttgtttgtttatttgaaagtaatccctctttttccaaaggcctgcatgctgccttgattctggaggagccagggattggcccaatgacccaaatgtttggaagtctttaagggcccttttcatgcccgtgaagtcacagaagtaggtaatcacccacctaccctccccaggtacccgatatngatgtgggtcagagggggctgagaaataactcagcctcaaagccttagaccgtcttctcagggtntaaccgtcatctcaggatagacaattcaggaagaggatgccttgccacacatgaggangtgggagtggcaaatgagcaggcgttgcattcagggcaggtttagaggaaggtttggcaggtgaatgatggtttgcgtacaaactacagacaagaaattgagaggacaactgggtataggtgaggtgactactctgccctcagaaaagtggaagtctgagttcatgggggaatgcctcttaaataacacagatgggcaaactccagacattagtgaaaccttcttcgttagacattcttttcaggggtttctcatacttccccaatcaccttaatcatcagtgctgaccacaactgatacctttctgggtgactcaaggccagtgctcaggcgggccaccgtgtgttgaatccagctgaagatgcaggtgcagctggaggaa

SEQ ID NO: 2253 - DNA, 700 bp, Homo sapiens
  misc_feature (1)...(700): n = A,T,C or G
ataacacagatgggcaaactccagacattagtgaaaccttcttcgttagacattcttttcaggggtttctcatacttccccaatcaccttaatcatcagtgctgaccacaactgatacctttctgggtgactcaaggccagtgctcaggcgggccaccgtgtgttgaatccagctgaagatgcaggtgcagctggaggaaggactagccctgaatgggcaccaaccccaaaagaatccactgactgtcacttaggcaaaagttccgcagtcacattgcttttggatcctccgcctcactcttcctgagaggtatttggtgcaaatagccggacctctggagtgggagacacctgactccagttcctgccacttcctccttcctgctagttgccagaccttggacagtttggtaactttgaatttgcccctgtcaaattnattcatttactcatgcactcactcactcattcactcaacataaattcctgagtagcttccatgtgccaggtactagtttaggtacttgggagtgatcagtagaggaaataggtaagtgttccgccttcagaaatgtgtatcatggcatgggaggtacaaaataagcaacaaagctgttaacaagttagaaagtggtaagtgctatgggaaaaaacagagcaagataagcagtgcttggagtggtggtagaaggggctgcaa

SEQ ID NO: 2254 - DNA, 700 bp, Homo sapiens
tgtgccaggtactagtttaggtacttgggagtgatcagtagaggaaataggtaagtgttccgccttcagaaatgtgtatcatggcatgggaggtacaaaataagcaacaaagctgttaacaagttagaaagtggtaagtgctatgggaaaaaacagagcaagataagcagtgcttggagtggtggtagaaggggctgcaatcttaaacagtatggacatggcagatctctgagaaaataacatctgagcaaagacttgaaggtgttgaaggcgttagccccttttaggcacagggaagagccagcgcaaaggctctgaggctggtgtgttcaaggagcaacatggaggcaagtgtggctggagcagaatgagtgagcagagagggtcacaggggaaaagaaagtgatggaaagataaaggggaagatgatgcggaccttgcaggccactgtgggaactatggcttttctgtggtaaaacacagaactccaagagggttttgaacagagggctatgatctgactagagcataacaggatcactctggctgctgagttgagaatagattatagagcagggaacaggtagaagcagggaaattagctaggcttccactgaagtatattctagaagataatagtggctggaatcatcatggattcagtggaagtggggagaaatgagaaatgttggattctgga

SEQ ID NO: 2255 - DNA, 700 bp, Homo sapiens
gaacagagggctatgatctgactagagcataacaggatcactctggctgctgagttgagaatagattatagagcagggaacaggtagaagcagggaaattagctaggcttccactgaagtatattctagaagataatagtggctggaatcatcatggattcagtggaagtggggagaaatgagaaatgttggattctggacctgttttggaagaagaatcatcagcatttgctgatggcttagatgttgagtatgagagagagatcagagttaaggatgactccaagggtttttctctgagcagctggaaagaaggatttgacctcaactgagacaagaagactatatgtggggcaggcatgaaggggaagattaggagttcactttagcacacataaaatgggataattatacttcacaggctgtagtgagggttaaatatgataatatatgaaaggtcttagtactagcaagctcttagtaaatgtcactttccctttttctttctcaaagaggtggtgaagcatgaacagctggggtccccaaaccaatttgactaattgcctttctgtagaagtaatgtgccaatcagatgccaagacagcctcctccctgtggttttctcactcttcaggaaactttcactgttgctaacagggtctttagatttgtcaaaggtttctcggtgatgttgacacac

SEQ ID NO: 2256 - DNA, 700 bp, Homo sapiens
ttctttctcaaagaggtggtgaagcatgaacagctggggtccccaaaccaatttgactaattgcctttctgtagaagtaatgtgccaatcagatgccaagacagcctcctccctgtggttttctcactcttcaggaaactttcactgttgctaacagggtctttagatttgtcaaaggtttctcggtgatgttgacacactgatgtgatgatgagtttctgcatcaggggcactgtggcgcccagacagcctccatctatgtgctcaccgtttccatatcagtcactctgctggtgtcacatgagcaagaggcatgatctcttcagcagaacagtttggttctacagacacacaccgacatccatatcactccttgtccccccacccccaggttgttatgggactgttgaaaaattacttacctgtgaggtaggtactattattcccattttatagatgaagaacaaaggttcagagaggcttgttatatgaattaagtgaatgagtatatgcaaaaatgcttagtaccactgtgcctagaacttagtaaatgcttgagaaaggttaaccattgttaataaatgttaatcattgtcagtagttcaagaaaggaaggattttctccaaaactacacttttgttataaaagacagtaggctgacttaacattaggtcacaactttatcttagctatttgaat

SEQ ID NO: 2257 - DNA, 700 bp, Homo sapiens
aatgagtatatgcaaaaatgcttagtaccactgtgcctagaacttagtaaatgcttgagaaaggttaaccattgttaataaatgttaatcattgtcagtagttcaagaaaggaaggattttctccaaaactacacttttgttataaaagacagtaggctgacttaacattaggtcacaactttatcttagctatttgaatcatttgattctgaataatattgttggcatgtggcacattacaatttttaaatgaacaaaacaaaaaaggttatagtctgtatagtagaagcattttcatacagggaataattggatatacttgactttatggatgagaaaatccaggtacctggaaggatgctacccaagggccatctttggatatgggatgctctttacttgtttgaatttttaacagtaaacttaaatcattcttaggacaataggctagtttgtaaagatgtctctgaaatgtccggtaagatttgtgtggtacctgtgtgattaactgttttcagtggttacattgctttatctgaggggccacctgactgtgctgacaccatgatggacagcccaagtcagggtgcatgagatagtgaggcctagcaaaacagattccttagaagtgcccaaacttccctcttcagctgaggttggtgactgctcagacccagagccgtgcacatgcttagtcat

SEQ ID NO: 2258 - DNA, 700 bp, Homo sapiens
tgtgattaactgttttcagtggttacattgctttatctgaggggccacctgactgtgctgacaccatgatggacagcccaagtcagggtgcatgagatagtgaggcctagcaaaacagattccttagaagtgcccaaacttccctcttcagctgaggttggtgactgctcagacccagagccgtgcacatgcttagtcatttgatcactgtctgagaaagccttctctctgggtagaaacgtaagaacaacttgaggtttgtagtatccctctcaagcttgtccaatccacggcctgtgggccacatgcggcccaggacagctttgaatgtggcccaacacaaattcataaactttcttaaaatattatgagacttttttcttttaagctcatcagctatcattagtgtattttatgtgtggcccaagacaattcttcttccattggggcctggggaagccaaaagattggacacccctgctctatacactggttggtggtgagtgagggctcaggtaaacatgagacatctttgacagcttcaggataacaaaatctctaggtccagaagttctacttgcaggcctcctgtagaactggcatatatgagaacaggaatctcatctttattctgtttaaatcctggagatttgattcatggcacctgccagtgtggacatttgcatgtgaatctcagata

SEQ ID NO: 2259 - DNA, 700 bp, Homo sapiens
tgagtgagggctcaggtaaacatgagacatctttgacagcttcaggataacaaaatctctaggtccagaagttctacttgcaggcctcctgtagaactggcatatatgagaacaggaatctcatctttattctgtttaaatcctggagatttgattcatggcacctgccagtgtggacatttgcatgtgaatctcagatacactggcttcattagcctgtaaaacagttcaagagacaggccaagttcccaaatggtctctcaagaaagctataaaattgtgcagaagcaaaacatttgagtacctgcctttcagccatgatgttttctatattggaagcctagtatcatcctgattcaacattttcctgggctcattcttagagtccagggcagcccagtttgaaaatggcataattctcatactctctgaccattggggtcccactaccgggtaccaaactgtgagggggtatattactggatgtgtcacagacatccaccctgccccacaccactgagatttgctgattggagtgactttaatggataatttctgccccaacactgaatgctcacacaaggcccttgactcttccctggtattcccatttatgcttcaattgtccttgcttccatttctgcccccttcaccttggcatccccagccctctgctttgatatctttgtggcttggatgc

SEQ ID NO: 2260 - DNA, 700 bp, Homo sapiens
accctgccccacaccactgagatttgctgattggagtgactttaatggataatttctgccccaacactgaatgctcacacaaggcccttgactcttccctggtattcccatttatgcttcaattgtccttgcttccatttctgcccccttcaccttggcatccccagccctctgctttgatatctttgtggcttggatgctgagtggagaggagagctctctttggtggtgagcaggagatgactagtggacctctgatgacaattgactctctctcctcctggcagccgccttccctcggctctaccactaccactgttcaaacattgctctctgctctccccatggccaggagctcaaaagctgctacagaccaggaggattccagcttggacaccttatgaccaatgagctacaacttcagtgggcatcatctgggcatcagcttggattatgaccaggtcaagttgctgagtgccaggcagtcaacaagcaactgctgtggcgtccacctgtcaaagttctgtcagttcaagatgcaagagcaccaggttgaagggcacttgctgcatgtcaagttcagttctttttatgattagagtcagagttccctgcaagtgagaacagagcccagctagacctggccccagggctcccttgctgtctgttccctcttccttctggatacttctggccctgt

SEQ ID NO: 2261 - DNA, 700 bp, Homo sapiens
  misc_feature (1)...(700): n = A,T,C or G
tgtggcgtccacctgtcaaagttctgtcagttcaagatgcaagagcaccaggttgaagggcacttgctgcatgtcaagttcagttctttttatgattagagtcagagttccctgcaagtgagaacagagcccagctagacctggccccagggctcccttgctgtctgttccctcttccttctggatacttctggccctgtcccagggcatttgacaggggcctccaagtacctaggccaactgaggagcagaggtagaggtgttgaaaagcctccacctgccaagaccttgagcactgaacccaggcagcctcctgtgccccagcctctgtcctctattcctttgtgagcccttctttgaccacttctccccctttttaccctcactctccagttcaggccatcaactctggcgaagcaaatataaaaaccttctcactgatccccttactgacttttggccagcacagtagcctgagggatcctttaaaaacataaatccagctccttcttgtcagtcaggtctcagccaaatgtcaccttctcagaaaggctcccattgaccatctanaatcttccatgccatcatcacatattctatttattttatttttattttaaaaataggtttaaagggcacaagtgtggttttgttacatggatatattatgtagtggtgaagtctgggctttcagtgtagc

SEQ ID NO: 2262 - DNA, 700 bp, Homo sapiens
  misc_feature (1)...(700): n = A,T,C or G
cagctccttcttgtcagtcaggtctcagccaaatgtcaccttctcagaaaggctcccattgaccatctanaatcttccatgccatcatcacatattctatttattttatttttattttaaaaataggtttaaagggcacaagtgtggttttgttacatggatatattatgtagtggtgaagtctgggctttcagtgtagccatcacctgaatagtgaacatcgtacccaataggtaatttttcaaccctcactccctcccatcttttgaagtctccaatgcctgttattccactctgtattttattttattatctccactgacattatcttgagcattcttttgtttactgctttactgtcttctttactaccttgtaagcatcaagagggcagacaatttgtcccgcatngccctaatgcccaggacagtgcctgataacatggtaaattggtactcaaaaagtatttattgaatgaatgaatgaatgaatgaatgaatnnnnccattcttaagaagagctcacattgccagtcactgggctgtcaagcagtcctcaggctgacttgagtgctgagtggagaggagagcctctccttgtggcgagcaaggcatgagcctgccataaccccaggagttacggggcaaggcctcttggcctagtggatgccagccagtaggccacgggtctctttaaaagc

SEQ ID NO: 2263 - DNA, 700 bp, Homo sapiens
  misc_feature (1)...(700): n = A,T,C or G
nnnnccattcttaagaagagctcacattgccagtcactgggctgtcaagcagtcctcaggctgacttgagtgctgagtggagaggagagcctctccttgtggcgagcaaggcatgagcctgccataaccccaggagttacggggcaaggcctcttggcctagtggatgccagccagtaggccacgggtctctttaaaagcaacaggaagccaagtcctggagataagaagtgtggctgccagcgtgatagaggtgggaagagggctgaagggtggagaggtgggggctgccgggcacctctgtgctgctccctggggatgcccagacctctgtggctggctggccagcaccacatgcttcctgtggagagcaaggagaggagatcccctccaaaggccctggagctgggactgccccagcagcctcacccttgtcctcactgtggtggttaagacgcagggctactgtcccacttctctgccattcatggacactagggcagctgccatagggcaagtgtcatatccatgtgctctctgcacctggctccctgtgcttctctgtgttttagactcttcattggtacaatggattcctccacactggtgattgtgaagagtctgggaagtctgggaggaactggggactgggggctagagtctcaaggaggagtgagggtctggagggctgagatactaga

SEQ ID NO: 2264 - DNA, 700 bp, Homo sapiens
  misc_feature (1)...(700): n = A,T,C or G
agctgccatagggcaagtgtcatatccatgtgctctctgcacctggctccctgtgcttctctgtgttttagactcttcattggtacaatggattcctccacactggtgattgtgaagagtctgggaagtctgggaggaactggggactgggggctagagtctcaaggaggagtgagggtctggagggctgagatactagatatgagaggcagcccgggtgtggtggatgggctggcaggggctagctagcatttggatgcaacataacaaagacctggcatccctttcagtgtctcatcccggctggttgatgccaagtagcaggaagagtgatgaaagggcacctgaggagactcagagactttggtttaagtgttgtatctgccactgtctggcagacaagtcgtttctctgctcacagcttcagtgatgcgtctgtgaaacgggtcatgttctctctctcacatgatcgtggtgagcattaaggaaattatgtaaatcatttcagtgactcttcaggcttcngctccccattcctgctggggtcatctcctaggatagtgaggatgtctgtggacacaaactaaggaagccagaaaaccgctgtcctgactcagtgtcttgccccaccctggcctctggcccagattctggaggccttagtcagggggtgggggtctgtttgcccagagctggggtt

SEQ ID NO: 2265 - DNA, 700 bp, Homo sapiens
  misc_feature (1)...(700): n = A,T,C or G
catttcagtgactcttcaggcttcngctccccattcctgctggggtcatctcctaggatagtgaggatgtctgtggacacaaactaaggaagccagaaaaccgctgtcctgactcagtgtcttgccccaccctggcctctggcccagattctggaggccttagtcagggggtgggggtctgtttgcccagagctggggtttccctatagatcctgtgggacagaacaagtgcagcccactggaaagcccttgaaacagttggatgtcaccctgtctgagaggagcttaaagctgccagaacggactggtggactggttggatccgcccccttgggaaaatccaggcatgagctgtcacctggacctgagtacagttcctgtccatcctgcactagcgaggccatggggaatgctcagaaggggaggcgtcgcgtgaaacctgcttaatatacagcctgtccaaaggtcccagcccccagccacctgaactgccaggactgttccatttccctatcctccacaggcctgccccgaggcccctgncaacaaatgtcacttccccacaccaacctgcttcctccaggattggtattttctgacttctatgtttttcatggcttctttgatgccaccgctcctgtttctctttctcctctgtgaccagttcttacaagcctcttacacagctgcctcctcctct

SEQ ID NO: 2266 - DNA, 700 bp, Homo sapiens
  misc_feature (1)...(700): n = A,T,C or G
ttccatttccctatcctccacaggcctgccccgaggcccctgncaacaaatgtcacttccccacaccaacctgcttcctccaggattggtattttctgacttctatgtttttcatggcttctttgatgccaccgctcctgtttctctttctcctctgtgaccagttcttacaagcctcttacacagctgcctcctcctctgcccatcttctaggtttccaagttccttggggcttggtacttctctctttggctaccctacaggtctcaaacttgcggtctaaaggccaaatcaaggtctgcaccctccaacaagggtccctaccttttcttaacctgccaccctacaaacaacacttcagactagtggtgttcccagacatgtttctgcatgcccctctttggggagaaactccacgattatggagccatcctaaatgcgagctactaggtccagatttctttgatctagcttcagcctatccccaccacacctcttaccagatcacctggcctggttgaagggctttctttaaggcatcccatcacaagcatgtttttctctgcccctttgccacctggcaaacgactcctcctcttttcatagactgaccaagaaactatagccgccccaacccagatgatactgattctgctcactactgctagggacaaaagctgcctgacaggtgtctctgata

SEQ ID NO: 2267 - DNA, 700 bp, Homo sapiens
cagatcacctggcctggttgaagggctttctttaaggcatcccatcacaagcatgtttttctctgcccctttgccacctggcaaacgactcctcctcttttcatagactgaccaagaaactatagccgccccaacccagatgatactgattctgctcactactgctagggacaaaagctgcctgacaggtgtctctgatacctggtggctgagatacagtgagtactcaatattagatggggagagggaccctgtagccatttctcctgaggagttgagtacctgagaatggcagagtgaggctcttccctgggcttatgtgtcacaataggaaagcaacagaatcccagttgccagggttgtggggggaagcgtggtttgtaagcatcaggctctgacccatctgcccagggacaagatttgtacaggctttttaaggtggtcttgtggatgctgtgatacacagctcagacccccctgccccatcccctttatgaatgaaagatttatttcaccagctggtgggagagctgccagaagacagccccagctgtcagccctattttggactactgctaaaaaataattgccttgtgtaaggtcacacctacttctgtagggagcccacgtctaccaactgataaatatgaaggtataaaggcttggctccctctccttcttgggaaaactctgaaggatc

SEQ ID NO: 2268 - DNA, 700 bp, Homo sapiens
aaagatttatttcaccagctggtgggagagctgccagaagacagccccagctgtcagccctattttggactactgctaaaaaataattgccttgtgtaaggtcacacctacttctgtagggagcccacgtctaccaactgataaatatgaaggtataaaggcttggctccctctccttcttgggaaaactctgaaggatcatcacagatgagcactcctggtctcagctggaacctcggctggaattgcatagtagctccacttctccttttgcctagtcctgtttcagtcctcatttccactgatgttgaccccaagatcttttcctaataaaggtcctacatgctcatatcctactcagtctgtttcctatagaacctaatctatggcatctggctttaggagtgacagaaaaaaaatgagatgctaagatatgattttggagctggatcatccactgttggctgccaatgaggactcccatcacaggtggcaggtgaagcagacagcttttggcccatggtaataattgttaaaacttttacctatgttggaagagaatgcattagatggtgcagtgcctcaggtgtttgagaaatatgggggaattagccactgcaaggacaatggaattgctaagcttgactaactttcagtaaaagaaaatggagagcttagagtgattaattggcaatgaaaa

SEQ ID NO: 2269 - DNA, 700 bp, Homo sapiens
agcagacagcttttggcccatggtaataattgttaaaacttttacctatgttggaagagaatgcattagatggtgcagtgcctcaggtgtttgagaaatatgggggaattagccactgcaaggacaatggaattgctaagcttgactaactttcagtaaaagaaaatggagagcttagagtgattaattggcaatgaaaacataagcatgaaagccgtaggcctctttggtgcatctatagaaaagaagaaaaagcagagaatcagacccagacttctgtcaaagtagttaagcttcaaagaaggttatattcccaaccaaggcaggtcttctatgccaagggcagagccctggttggggaagaatgagaccctgacacgtgggatgaggacctctgttgcacctgaatatcttgaatcctcagatttcactaaacactctggacctgcagaagtgacctactcatctctgttaaaagctagaacttgcttcttactttaaaaagaaaatgcggaggcttctgtcctgcaagacatgctctcattccatgttacctctttgtgctaggccaataactagggttaagtcaaaacctaacctggccagacatgctgaacttgctagtgtagaaaaggactatacctcaaaggaaattctggtcatatccagagagtactagcaggagcttggagagtatgca

SEQ ID NO: 2270 - DNA, 700 bp, Homo sapiens
aaaagaaaatgcggaggcttctgtcctgcaagacatgctctcattccatgttacctctttgtgctaggccaataactagggttaagtcaaaacctaacctggccagacatgctgaacttgctagtgtagaaaaggactatacctcaaaggaaattctggtcatatccagagagtactagcaggagcttggagagtatgcacaggactggattctggaccaagggggtggaacagaaatttgaacaaaagagtttatggatatgggaacattcttccaggataaagtatttaaaactgtggcaaggccccaagagatggtgcaaatacatcgtttggatggctcctagaagcatggaaagaggatggcccatattaagtgagggtagccagaatggctatggcagactatgaaggacgtgggtgtgcaggaataaatatactaagcaaattcagaatactcgcctgagggccaagaagataccaaaacaagaaatgtattggaaagaagggcaccagtatcaccaagaactaaaatggtggctaaaataggccagcattgataggaaatgtcacagaactgggctcactgatagcagtaggggtgataggactctgagataatagaggccaagtcatagcacttggcccagttgtctgggtggcaagattggaatggctgttaagagggcctggctcccgg

SEQ ID NO: 2271 - DNA, 700 bp, Homo sapiens
gaaagaagggcaccagtatcaccaagaactaaaatggtggctaaaataggccagcattgataggaaatgtcacagaactgggctcactgatagcagtaggggtgataggactctgagataatagaggccaagtcatagcacttggcccagttgtctgggtggcaagattggaatggctgttaagagggcctggctcccggggagttatggacatggttaataaaacatagcatctggagggtcacaatagatggccagccaacagtgctgcgggttattctgtgcaagaaaaagaaatcaatcatggataatgagtccagtcaccccaataaaaagtaacctgccgagtttccagatctgaaccagttttcagacttagaacctactgattgaagaagatgccagatctcccagaaggaagagtcccacaccaccacagcaagtgtgcatgataatgatttccccagccctttcccagggggacctgtgggcacttaacctggatagctacatactaggaaagagaatatcctaacatgtgaaagactattgaacccgggattagaattgacattgttacctaggtacctgaagtggcaccaaaatcctctcattagaatgaggggtatatgtgggccaggtgatagattcctggcctgagttctgctaatagcaggtcctctgggtccacagacccaca

SEQ ID NO: 2272 - DNA, 700 bp, Homo sapiens
tggatagctacatactaggaaagagaatatcctaacatgtgaaagactattgaacccgggattagaattgacattgttacctaggtacctgaagtggcaccaaaatcctctcattagaatgaggggtatatgtgggccaggtgatagattcctggcctgagttctgctaatagcaggtcctctgggtccacagacccacagtgatataatcagatcaacacacttgataattagcacagcccctacattgggtccttggcctgcatggtgagagtgatcatagtgaagaaagccaagtggaagccttcaaaaccttcccattccaggcaaaatagtaaatcaagaacaatatcacattccagggttaatggcagaaattattgccaccattatagacctaaaagggagtccgtcatatcttcatttaatttaccagcaaaacccagttaaatcctgaaagatgacagcaggctactaccaattcaacagtagccccatttgcagccactgtgcttgccaaatgtgtcttcactacaacagattaacatgggctcaggcatacagtgtgtagctgctgatttggtgaatccattcttttccacccctgttagaaattgtttgcattcacttgggacaaacaacagttcaaatttccaaggcaaagttaactctcctgccctctgtcataacatagttccaa

SEQ ID NO: 2273 - DNA, 700 bp, Homo sapiens
gcagccactgtgcttgccaaatgtgtcttcactacaacagattaacatgggctcaggcatacagtgtgtagctgctgatttggtgaatccattcttttccacccctgttagaaattgtttgcattcacttgggacaaacaacagttcaaatttccaaggcaaagttaactctcctgccctctgtcataacatagttccaagaagtctgaaccacttgggcatcctgcagaacatcacactggtctactctattgataatattatgccagtcagacaagattgatggccatggcaagacacatgcactccagaagataaaccctatgaatattcacagcctgccacatcagtgaagtttttaggaatccagtagtctggagcgtgcagaaaattcccaccaaagtataggacaaatcactatgtcttgtacttcccaccatgaagaaggaagcggaatgtttggcaggcctcttagggttatggatgcaacctatatggatgaaacctattacacacttgggaatattattctgaaccatatacctggcagtgacacaaaagcctgccatctttgagtggggccccaggcaggaaagggctctttggctgtagtacatgtagccctgccatgtgggccatatgagtcatcagatactgtggttttaaaggtatctgtactgggaaaatacactgtccctag

SEQ ID NO: 2274 - DNA, 700 bp, Homo sapiens
gaaacctattacacacttgggaatattattctgaaccatatacctggcagtgacacaaaagcctgccatctttgagtggggccccaggcaggaaagggctctttggctgtagtacatgtagccctgccatgtgggccatatgagtcatcagatactgtggttttaaaggtatctgtactgggaaaatacactgtccctagggttctggaacaaggccataccatctgcactggagaattacataccttttgaaaaacagctgtgccatgcttctgagccttggtaggcctggagggcctgactcagtgaccatgcagcaagaaccaccatgatgaattggtttttgtgagacctactaagccataaggtcaggtgggctcaacagcaatccatcataagatggaagtggtacaactctaaccaatgagcaggattggaagacacaaataagctgcaggtgcaagtgacccagaaccctgtaccatccaactccaggacaccaaaaccttcccccagctcacatctatggctgcatgggtgatcccttgtgtccagctgatggaggatgtaaaagctcaaacttgattcccaaataagttcagatacaatactcggcctcagggagatcaagagaccaccccactgctaggtgactacattagccctcttatacccctgaagggccagtgattcattttga

SEQ ID NO: 2275 - DNA, 700 bp, Homo sapiens
caaaaccttcccccagctcacatctatggctgcatgggtgatcccttgtgtccagctgatggaggatgtaaaagctcaaacttgattcccaaataagttcagatacaatactcggcctcagggagatcaagagaccaccccactgctaggtgactacattagccctcttatacccctgaagggccagtgattcattttgacaagaataaagacacaatttaagcatgaggttgcctttcctggctgcagggccacagccaacatcactatccaagggccttcagagtttttattcccctggtatgggatctcacatagcatatcagactgagggatctactttatatcaaagaaagtggaagcacaggtccatgaccataggatgtgctagtcatatcacatattgcaccactcaggtgttgtcagtttggtagagtgttgggcaacagcctgttgatggcatagttgaagcaccggcttggggtgctactttacaggataatgaactattcttcaggatgcagttctcactataaatcaaagaccttatatggagctctgttccaataggtataatacaagagtttcagaaccaagagataaaaacaggagtggccccctttactatcattcccagtggcccacttggaaaatatatgcctcccatccctgcaaatctgggctctgtgggtttggagat

SEQ ID NO: 2276 - DNA, 700 bp, Homo sapiens
aatgaactattcttcaggatgcagttctcactataaatcaaagaccttatatggagctctgttccaataggtataatacaagagtttcagaaccaagagataaaaacaggagtggccccctttactatcattcccagtggcccacttggaaaatatatgcctcccatccctgcaaatctgggctctgtgggtttggagatcctggttccccaggagggaacatttccagcaaaagtcccattagactatcagctagggatgctgccagggcacttcagccttcttgtgtctagggacaagcaggaaagaaaaggaggtaccatcttggcaggggtacctgagcctgatcatcaggaggaggtaagactacacagtggaggcagggaggcatacatgtagcaccccggtgatccagttggatacctctttattactccctttcccaattttgacagtaaatggacaagtgcaacaatcccagcctgagatggaatcagacctcttagagatgaaggattgggtcatgctaccaggtgagccagcaggatgagcaaaggtgctaactgagagtgagggggaatctggaatggatagtagaggaggagatgatgagtgtcatttgtggccctgagatcaactgcaacagcagggactgtagttcattgtgaaccttcctcttctaagtctcccagaagtagaa

SEQ ID NO: 2277 - DNA, 700 bp, Homo sapiens
tcttagagatgaaggattgggtcatgctaccaggtgagccagcaggatgagcaaaggtgctaactgagagtgagggggaatctggaatggatagtagaggaggagatgatgagtgtcatttgtggccctgagatcaactgcaacagcagggactgtagttcattgtgaaccttcctcttctaagtctcccagaagtagaagcctgctggaaccattggtgtgctagagctggctacttgctcgtgagatcccattgctaaagttgttgccagtctgtttttaaaccgttggtagtgcaccgatggtgggagtatttataccatgatagtttttttttctcttttttttttttttggagaaccagttattgatagcacaccactggaatcctggaggagctgctcccagaaccagtgggaagtgtttatatgaagaagtggatccagaaagctcaagggatggactatggtggaagctatgatatgctgccctgaacacccttcaggagtcaaggtctgattgcccctgctgaagaaaatttccgtgcctaaggtcatgcttccttccaggggcagcttacatccaattactgatcaaaatgaaggcataaaggcttgacctccttgccccaacataggaagagtctgaagggccatcccagctgtagaagtctccttaggatcagctgagacttttgttg

SEQ ID NO: 2278 - DNA, 700 bp, Homo sapiens
ttcaggagtcaaggtctgattgcccctgctgaagaaaatttccgtgcctaaggtcatgcttccttccaggggcagcttacatccaattactgatcaaaatgaaggcataaaggcttgacctccttgccccaacataggaagagtctgaagggccatcccagctgtagaagtctccttaggatcagctgagacttttgttgtgactgtattttgtccaaattctccctctgttcaatcctgcttccttcccttcccttccatgagcagtcctgcatgccagtttctgtctcagagtctgcttcccagggaacccaacctcaggcaggcagcctcgtcatgctttcagcacaacggtcccctgaaagtagaaaaacctcagctcaccccaggggggttcttggaccctacagcctcagagcagagtgtgttcaagtcagcttcagtctctgcagctatgaaggggactaatcaccccatcctcacctggcctggaattgctcccctgggtcaaaaccttttaggccctcaggcctctggggcctggaggtcatgaggggtggtgagaagagaaggcggccaggtggagctcaacatcctcggatagtcgtgcaaatgccggactatagcctcttctgggcaccgccccctgtgccaacagagtctggactcatagtggttcctaaaaggaccttttccacga

SEQ ID NO: 2279 - DNA, 700 bp, Homo sapiens
ccctgggtcaaaaccttttaggccctcaggcctctggggcctggaggtcatgaggggtggtgagaagagaaggcggccaggtggagctcaacatcctcggatagtcgtgcaaatgccggactatagcctcttctgggcaccgccccctgtgccaacagagtctggactcatagtggttcctaaaaggaccttttccacgacaagcacagccaccatgctgggagtaggtggccccaggagagatgtcgaggaggctttctctgccccacaggccaggaaggggaggaaaaaaccaggagaatggattgattcttgagtctgactccagggacagtgagggccacagcctactaccttcctgggacttgtggggttgagggcattgtagtcctggagaaatgggtcccaagagtcccacaaagtctctgatcacagtgccaagaggaggaacctccaagagaatcgggatctgcagtcaggggctgagctcagagacagaatggccacattttaacctgaccacagcttgcaactgcgtctctgtctgtccctgccaggggctcttgccaagtccgccatctcctctatgtctgtcagtctttcactgccagcgttccctcttgtctctccatctgtcctttccaggctctcgctgagtctaactgtctatcagtgtctgtccgtttactcatcactgcca

SEQ ID NO: 2280 - DNA, 700 bp, Homo sapiens
tggccacattttaacctgaccacagcttgcaactgcgtctctgtctgtccctgccaggggctcttgccaagtccgccatctcctctatgtctgtcagtctttcactgccagcgttccctcttgtctctccatctgtcctttccaggctctcgctgagtctaactgtctatcagtgtctgtccgtttactcatcactgccaggagcctgagctatgcctatctgtttgtctgcccctgtcatggtcctgctgtgtctgtctgtctgcttgtgactcctggtccttcagcctgacagagtctaaggtcagatgctccttcctaacaggggggttcattgtaacttggggacctggtccttcagcctgacagagtctaaggtcagatgcaccttcctaacaggggggttcattgtaacttggggacccaggcccacacccatttttgtttgatctcagagcccaaggctgcatatctctgtccctcagccccataggcacaagaacctttggtgtgaccatggcccagggtatggctcgaggctctggcagcttcctcttatttccacctgggttccaacactggttgctgcccatgtccaggactggattggtgagaggaggcattagggtctgtctgattcacagtgctgcccctagccctgagaagagagagagcttccatttcagttgaggactaagag

SEQ ID NO: 2281 - DNA, 700 bp, Homo sapiens
aacctttggtgtgaccatggcccagggtatggctcgaggctctggcagcttcctcttatttccacctgggttccaacactggttgctgcccatgtccaggactggattggtgagaggaggcattagggtctgtctgattcacagtgctgcccctagccctgagaagagagagagcttccatttcagttgaggactaagaggcacccacagaatctgccccagagaggtcccagtgggagaagggacctgaggggtatggagttcactcagggacagcttcctggagtgtaaggggagaggggagactatgagttatcctgttattgtgttgtttctgactggctccaacccagttgctgcttccctggcctcccttccccagcacatgacctcacccttatccagtctggtagaggaagaggcctggataggagccagggcctccatcaggagagcttggggctgccccaggcctaactggaggaagtgtgacacattcccagagagctgggcttccctccctcctgcagcttcctttgagatggttcccgaatccgttaagtgggaaaaagagctggcagctgtgctggtgttgggctcccagttcccctggctcctggatggccccaagggcctcctcttggctccctcacagatgctatttttgataagaataatgaaaacaacagccctggctgtg

SEQ ID NO: 2282 - DNA, 700 bp, Homo sapiens
cagagagctgggcttccctccctcctgcagcttcctttgagatggttcccgaatccgttaagtgggaaaaagagctggcagctgtgctggtgttgggctcccagttcccctggctcctggatggccccaagggcctcctcttggctccctcacagatgctatttttgataagaataatgaaaacaacagccctggctgtgtacttagtacctgcttatagcctgttgctgatcttggtcccaagaacattttctaaactttggaaaattggatgttgcctttccatccggacttctgtaaaagctgtgtgcatttcttttattcaaaggtgaaaagaggctcactttcatcagactctggaacatagtcactgctggcacttgatgccatgaggggccctcctccgagctgggggataaagcagtagttcagagcagagaccctcacagtcccctgaggaacagatgacagtccacccctgtggcgtaagaggtgggcaggcaagcctcagagtaggtgttgaggaagaggaggccccagtgcaggacctctccacctcccactggacattagtcttaccccattgtggagacagatgtcaaccatttggctggggtgcattccaggcaggggtagcaggtgatggtgggagtgctgtggctggttcgtgttactggggtccagggctgatatgaaggag

SEQ ID NO: 2283 - DNA, 700 bp, Homo sapiens
gcaagcctcagagtaggtgttgaggaagaggaggccccagtgcaggacctctccacctcccactggacattagtcttaccccattgtggagacagatgtcaaccatttggctggggtgcattccaggcaggggtagcaggtgatggtgggagtgctgtggctggttcgtgttactggggtccagggctgatatgaaggagatggatggtgagcaatgaggctagaggtatctgcaggggctgacggggccagggcagtaagggagggtcttaggtcagaccaaagggcttggagttcatgctgagctggcaggtaacccttatgacacacagccagactaacccctaaagtgtaagctcctcaagggttggtttcctttcagagcctggcacagttcctgacactttgtaggtgctcagtacatatttatgtaatgaattaatgggtggctgctgtggggagagaagcaggaagggtctagagacaaggcctgtgggtatttggggtgattgtctgcattagtgaggtggactgggtcagggcaaagccataaagacaaagagaagtgggcaggttggaaaggggctgggaagatgaatgtaccaggacatggcaggggactgactaagggaccgagacctcaagaggaacccaggacagtacccaggtctctccacttggtttctccacataggatagc

SEQ ID NO: 2284 - DNA, 688 bp, Homo sapiens
tctgcattagtgaggtggactgggtcagggcaaagccataaagacaaagagaagtgggcaggttggaaaggggctgggaagatgaatgtaccaggacatggcaggggactgactaagggaccgagacctcaagaggaacccaggacagtacccaggtctctccacttggtttctccacataggatagcaaaacattacagtttacctggagcctcccagaggctctgagaccttgtagataagggctgcactccacagtgtgctggcaagacaccatccacagccacatcaaactgggccctttgtgagctacctctcccaaaaaggagatgcaggagtaaacaacgcagagaagaatttctggtaatgatgggagcatttgggaagcaggctcagatcatatgaaagaagaagagagttccagtgtctggtggataagcagtgtctacaaaaggcaggaaaaccaacagcaacattgttcatgaaagactttttttttttttttgagatggagtctcgctctgtcacccaggctggaatgcagtggtgctttctcggctcactgcaagcttcatctcctgggttcaagcgattctcctgcctcagcctcccaagcagctggggactacaggcatgtgccaccatgcccggctaatttttttctatctttagtagagacagggtttca

SEQ ID NO: 2285 - DNA, 700 bp, Homo sapiens
actttttttttttttttgagatggagtctcgctctgtcacccaggctggaatgcagtggtgctttctcggctcactgcaagcttcatctcctgggttcaagcgattctcctgcctcagcctcccaagcagctggggactacaggcatgtgccaccatgcccggctaatttttttctatctttagtagagacagggtttcaccgtgttagccaggatggtctcgatctcctgaccttgtgatccgcctgcctcggcctcccaaagtgctgggattacaggcatgagccactgtgcccggccaatgaaagacttttccttgggaaaatattaaatatttgccagcagctaaagctagtatttagttaaagctaaaatatgtatgtcctatgacctagcaattccatgtcattcccagcatttccagaagaaaggtaaacatatgctcaccaaaacatgagtgcaggaatattcagtgaagctttattaatattagccccaaagtggaaacaccccaaatgtctgtcagcagtagaataggaaatttttttttaattaaaaaaattttttttagagacaggttctcactcggttgctcaggctagagtgcagtggcataatcacagctcaccttagccttgaactgccgggctaaagcagtcctcctgcctcagccttccacgtagccaggactacaggcctg

SEQ ID NO: 2286 - DNA, 700 bp, Homo sapiens
gtggaaacaccccaaatgtctgtcagcagtagaataggaaatttttttttaattaaaaaaattttttttagagacaggttctcactcggttgctcaggctagagtgcagtggcataatcacagctcaccttagccttgaactgccgggctaaagcagtcctcctgcctcagccttccacgtagccaggactacaggcctgcgccaccaggtccagctaattgttttatttttttgtggagatgaggtcttgctgtgttgaccaactggtctcaaactcctggcctcaggcagtcctccttcctcagcctcccaaagtactgggattacaggcatgagccactgcacctggccagaatagggaaataaattttaggatatttttataatgggatattatacagcagtgaaaaataacgttacaatgatgggcaataactagagaattacacagacacagcgttgaatgaaagaagtcaatcataaaagggtatagtacatgcttctgttctaaatgaagttcaagaatgggcaaaactaatttatggtggcagaggttggaatagtggctatacttggagggaggatactgattaggagcagggaagtacaaggaaggctttggtggtagtggaaaatggtgtatgtgtttccctgggtgccagttatttatataggtataaatataaaaactcactgaac

SEQ ID NO: 2287 - DNA, 700 bp, Homo sapiens
cttctgttctaaatgaagttcaagaatgggcaaaactaatttatggtggcagaggttggaatagtggctatacttggagggaggatactgattaggagcagggaagtacaaggaaggctttggtggtagtggaaaatggtgtatgtgtttccctgggtgccagttatttatataggtataaatataaaaactcactgaacgatatacttaagatttgtgcacttcatttgtacaatattgcaataaaaatgaaaataactttttaaaaggtttttctccacctacacaagaactgcaggcttttgaaggaagtgctgaacttccaggtggtatgttaacggaagggcctgggaagttcgtgctgatcttcccttgaggttgaccaaaaaaagggagaaagattttaattaatcatctctcaggttgaaagagcaggtctgggccagagataacatcagcagcaccaacatgaaactgtttcgctgctcttttcttaaaccacagtgaaaaataacttttgaagttgcatttttcctggcagtcatggtgcagggtcccctcacagaagggaaattggtcaactgtttccaagagtgaggcctgtgtccagcagccctttagaggacccagagagggggtttctgtggggccaggctcaacaattctgtctagcttacctcctgtgtggtcctgaggaagt

SEQ ID NO: 2288 - DNA, 700 bp, Homo sapiens
acagtgaaaaataacttttgaagttgcatttttcctggcagtcatggtgcagggtcccctcacagaagggaaattggtcaactgtttccaagagtgaggcctgtgtccagcagccctttagaggacccagagagggggtttctgtggggccaggctcaacaattctgtctagcttacctcctgtgtggtcctgaggaagtccctgccctctctgggccttggggctggggagcttccagcactgacagtaggtgagatggctgctcatcacccccagctcccatcttgggggctgcccctgttttgacttgctctgcagactgcatgccatgagtgtctggcctccccacccctctgaggaacagggcacgcatcagggtgttctcagcagcaacaggttttcccgactctgcatctgcctggtcttaatggtgtcagggcaagctggtcttgggctggggtctttccatttctgcctcacccctacttcacagataagaaaacaggccagagagggacccacgcatcacatttcttgtgaagcccatgtaacaaagtgggaggatccacggcaggagccgctgggtccagggacaccagccatgtgccttcagcacaaaccagcagcgggctcagaagcctgggacagcacagtgtggtgcctgcagcccctgccctccacttcaattatgcagaccca

SEQ ID NO: 2289 - DNA, 700 bp, Homo sapiens
aaacaggccagagagggacccacgcatcacatttcttgtgaagcccatgtaacaaagtgggaggatccacggcaggagccgctgggtccagggacaccagccatgtgccttcagcacaaaccagcagcgggctcagaagcctgggacagcacagtgtggtgcctgcagcccctgccctccacttcaattatgcagacccagcttaccaagcacatacatatgcaggcagccaggaaccaggagtaaagtctccagaacatagcacatctgattaccagggccagtcctgtccatttggggctggcgtggtgcaggccaaatgggtagccccctatctgtgactccatgcacagggcattaacgtgtgaggttaactgaggatgtgtggacagcacttgcaccctctcaggccatgctgtgagctgttctgcctgtccgggaggagcagacaggcctcttctgctgtctgtgctgaaagaggcaccttggctcttgcccaggcaggaatgctgtgggcctttgagggaacctgcctcattgtaagctaatcaagatgttcagcatcttggccgaacagccaacttgtggaatcagttgacacaaggacaccacagagaatctcatttagccagggacactgaggatggaaattttctataagcacggggaccacgtgatggccgctgacctgggcactgag

SEQ ID NO: 2290 - DNA, 700 bp, Homo sapiens
gcaggaatgctgtgggcctttgagggaacctgcctcattgtaagctaatcaagatgttcagcatcttggccgaacagccaacttgtggaatcagttgacacaaggacaccacagagaatctcatttagccagggacactgaggatggaaattttctataagcacggggaccacgtgatggccgctgacctgggcactgagcccctctcttcagatcaagccatagggaaaagctcatctgccatcccacctcccaagtcatcatcccaattcccttccagtccctggcccacatggggttatcctggcagccacgccatactggacctttcagggatgcccttccacgttgccctgttagtttcatgcccatcatttcatctcacagactgacagattggccatttccatggatgaagcttccctccttatgtgtggtctctctgggtatgaatgccaagtcaaaggatgtggccatactatgactgtgacagagactgctgtggggctgctggttctcaaggcccagcatatgagagagggctgccctgctgccttagcgtatttcttagatttctggttccagcctcaatgctactgatttctgtagtgggagagagtacagaggacacggagggtggtagagagtagaggtggtccttgggaggcccatgtgaaaggaggggctatcccattgtctt

SEQ ID NO: 2291 - DNA, 700 bp, Homo sapiens
tgtggggctgctggttctcaaggcccagcatatgagagagggctgccctgctgccttagcgtatttcttagatttctggttccagcctcaatgctactgatttctgtagtgggagagagtacagaggacacggagggtggtagagagtagaggtggtccttgggaggcccatgtgaaaggaggggctatcccattgtcttgagaggtcttgatgtgtgaatgaatcttctcaggccaccaagccctgctcttcctcccagtctagagcatttcctcagggcccggcctgctatagttgtctcctacggaagaatattgtttggacctatttcttggcctccttgggaaagggagtacccagggccagtcccagccaattgggagtcaagaccaagcttcttgggcccaggtatccagcccagggctccaggaatccagcaggccagcatcttgagatcctgaagcagcaatgccagcaggcttctggggagctgtgggctcaggcctgcctgagtctcaggtgcagtacccacatggccctcccacctggttccagcccccagcaggctccctagccccactgtccagatatgagtctacctgacggtagaacaagggcacatggaaaactcaggtggccgtcactgcagtctcttcatgggtagctgtttggtgactttgaccaagggttaaggctgtc

SEQ ID NO: 2292 - DNA, 700 bp, Homo sapiens
caggcctgcctgagtctcaggtgcagtacccacatggccctcccacctggttccagcccccagcaggctccctagccccactgtccagatatgagtctacctgacggtagaacaagggcacatggaaaactcaggtggccgtcactgcagtctcttcatgggtagctgtttggtgactttgaccaagggttaaggctgtcagggtgatgagggcagtcacttggtttagtacagccagcttcccaccagtgccccttccaacttccctgtttaccagaagaggtaccagaagctccctgtcaacccttctgacctcagtttccccagagttgagccagatgccctgaggtcctttcgctggataaaaaccgtggacctgagttctgatctggcctctggggctggagttcaccccacctttgcggactctgtggctgagagactgaagtacctgtcccaggtcacacaacaagctagtggcaggccagtctcacatgtaccatgctgtgctgaacgtggcactgaggtgaaaaggacatacgtctatgctccccacccccactgtcaggtacctcaggctttgtcaggagctcaaggtcaggagacctcatgcctggaggaggtctggggcagggaagaggaggctggggcagggaagtggagggtctccttgccagagtgtcccagcagcgccatccag

SEQ ID NO: 2293 - DNA, 700 bp, Homo sapiens
catgctgtgctgaacgtggcactgaggtgaaaaggacatacgtctatgctccccacccccactgtcaggtacctcaggctttgtcaggagctcaaggtcaggagacctcatgcctggaggaggtctggggcagggaagaggaggctggggcagggaagtggagggtctccttgccagagtgtcccagcagcgccatccagctatgcacctcatacactccagagccttgggacctctgagcacccaggtggtgcacccaagggacaagagcttacagtctctggtgactggattgtgggctttctctggactgaaaccacccttggaccctggccttgcactagcccctgacatctgatcctgaatcacagggctaccctccatgttctagatgatttggcaacttttctcaggcacagttgctgacctccagactgatgtgttccctcaaggtggagatgagcagtgggggtcttgggatcctagggcaagggatggggtgggcaggtgtgtggttggcctgcatggctgcaggtgctgtccgaagctttacagctgggcaggtttgtcgatgggcagatgtggcaaactccctgcagttctggcctgggctaagttgtggttgcaacttaacaattatgttccagaacaaatgggtctttatcggtcctggtcaggtggagaaactcacagttggaga

SEQ ID NO: 2294 - DNA, 700 bp, Homo sapiens
tgggcaggtgtgtggttggcctgcatggctgcaggtgctgtccgaagctttacagctgggcaggtttgtcgatgggcagatgtggcaaactccctgcagttctggcctgggctaagttgtggttgcaacttaacaattatgttccagaacaaatgggtctttatcggtcctggtcaggtggagaaactcacagttggagagatttggattgtaggaagctgtgtggactgtggagtaatcccagttgcctccaataaactcaaatgtttagaattcaagttagagctaagggtagggggtcagagctttgtagcccagtctggcagcactttaggactcaagcaactggcatttcaccccaggcagggcccagtgctctgcgggtgtgaggtggtactagtcatggaggggccgtcatgccatggagacacaggagagtgttggccacggttttgcaggccaagaaagagattttactttgaggtcagatgactctgttggtccagaggaagccaggggtttggagatgtccctggcctctgtgggccccctcctccccaggtcccacactgtgcccagtgctctgtgagtcacctgaaaggccctgttcccctgagccatttaccagggctgacatttctgtggtgccgcactgggccttgagggggtggcagggctggattagatttagagctcccca

SEQ ID NO: 2295 - DNA, 700 bp, Homo sapiens
gtccagaggaagccaggggtttggagatgtccctggcctctgtgggccccctcctccccaggtcccacactgtgcccagtgctctgtgagtcacctgaaaggccctgttcccctgagccatttaccagggctgacatttctgtggtgccgcactgggccttgagggggtggcagggctggattagatttagagctccccaggagctatgatacagaacagaggacggagagctttgatcttcaagtcctggcacttggatctggagtgggcaggtgctgactgaggctagggaggcgggcctgggaaaggacctgaaatcttgagttctgatggacacaaggagaaggggggcataacaagttgatagagcccctactgtgtgcccactggcactggagatgcagtgggggttcagatgaggtggggtcccatttgcctcatccacggccagatacttctcctgagagacccgtggaactccaggtatggagcccagaaatggagccatcgcctccaccctttgcagtctaacaggactgcatccccacgaggctggactccatcatgactctcactcaccagcatttccacatgctgggccttattgaagcagcaggtgtcagttacagaaatgtgtccccaggcaccaccacccccaatacccacccacacccttgtctgccggcccagggccagcaa

SEQ ID NO: 2296 - DNA, 700 bp, Homo sapiens
tggagccatcgcctccaccctttgcagtctaacaggactgcatccccacgaggctggactccatcatgactctcactcaccagcatttccacatgctgggccttattgaagcagcaggtgtcagttacagaaatgtgtccccaggcaccaccacccccaatacccacccacacccttgtctgccggcccagggccagcaaactcacaccccaacccagcagtaagttgttcctgatgcttttccaatcaatttcctgcagtgctaacctcgggagagggcaggagcccagaggctgcccttgatcctcttagaagatttccatccttctatggatatgataacactctataaggcttccttgaacttggagaaatgactttactcaatagtaccattcttgggtgagtctgttggctaaacgagaaatacacatttcagtcatcttcttagtaggaaaaacaatgaataaataaaagcaaacgcttgtccttccagccatcctctaggaggtaactggcagccctccccaactgtttgagggagggcacaggggctgtgtggtgatggaagggtccagagtctgaggactatccatagtgttggagagggagcccgcaggataggcaggtcccgtggctgtccaggacagggacataaggacaagcaggctgggaggagtacccaggactgtctgagcag

SEQ ID NO: 2297 - DNA, 700 bp, Homo sapiens
cctctaggaggtaactggcagccctccccaactgtttgagggagggcacaggggctgtgtggtgatggaagggtccagagtctgaggactatccatagtgttggagagggagcccgcaggataggcaggtcccgtggctgtccaggacagggacataaggacaagcaggctgggaggagtacccaggactgtctgagcagtgggaaaagagggggaggcagctcagtcacttctccaggcatgcccctgcaaactgctgctcatcccccccatcatgggttctcagtgggcttcatcatccaaaagaggccccaaggacagggcaaactggagcaagcttgcactggttctcagttcaagtccatgacctcagcctgagtccatgaccagtcctgctctgacctgtctcagacctatcccatgctgatccctgtgcatgggggcttggcagagagcacagacagaaaccctgagaatctctgaatccccacttcctcacacccagccctgcactccccaccctccaccttgtgtcagtgagtagacttcttttagattggagacaattccagaggatagccacctgtggcctaggagtagcaccagagaccttgcatgtggcagtcagggtgtataaaagccctttgcctcactgggcccctggctgtggtgcagggaaatgatgtctcaggttctgcta

SEQ ID NO: 2298 - DNA, 700 bp, Homo sapiens
cccagccctgcactccccaccctccaccttgtgtcagtgagtagacttcttttagattggagacaattccagaggatagccacctgtggcctaggagtagcaccagagaccttgcatgtggcagtcagggtgtataaaagccctttgcctcactgggcccctggctgtggtgcagggaaatgatgtctcaggttctgctaagagcaaacagcaaacaatgtactttcagctttgggcagattttgatgagttattccatgtccatgtaaaccttcgttatgtgatggtcctgtttgtcatatttgttaatgagactcttcagggtgaaggtaaagttctttgtaaactcctcatagcagagctcctgaaacaggttcagggctctggtgcacagcagggcaccagatgacccagcctcatccatccctggtcaacctggacggaaggagccctggacccaagctcaggccctaccctgattctcccacaaggagacctgtgggtctcgcaggccaaacagtggaggcaatgggcatctggtctctccctgggctcagggctgcacttggttgggaggctcacctgctgactgagctggaggtttcatccccacactctgagctttctcccagatttctcactccactatcccttgttgttatctcttccctgggcactgactggtgagatctctctctcc

SEQ ID NO: 2299 - DNA, 700 bp, Homo sapiens
gggtctcgcaggccaaacagtggaggcaatgggcatctggtctctccctgggctcagggctgcacttggttgggaggctcacctgctgactgagctggaggtttcatccccacactctgagctttctcccagatttctcactccactatcccttgttgttatctcttccctgggcactgactggtgagatctctctctccctgttcaaatgtggtatgaaaggtcccggggcagctgtttcttacctcactggttttctggggcctattgaagggaccccggaagccagagaaattggtcaggagcacaaaggggcactaagagcaaaataacgtttgatggagacccagacttatcttgtgtgtgttattgtcagccgagagttctttctgaatgtcagcacagattgctgtgtacttttcgtggggagatatcgtggctactttcattgggaagaatggctttctgacccccagagcacatgagccaggagcacgtacaggtgcatggtattacttgaaggtgactccaagctggtccgagccctgggcttggcagcatttctgtggagaggggtacctatatatgtgaggctaaggaaatgctaaacctcttatcagtcatcactggcttacgcggaagacagagaggaccttatcgctgggcaagatgtgattttcatgcattttcaacaaccaca

SEQ ID NO: 2300 - DNA, 700 bp, Homo sapiens
aggtgcatggtattacttgaaggtgactccaagctggtccgagccctgggcttggcagcatttctgtggagaggggtacctatatatgtgaggctaaggaaatgctaaacctcttatcagtcatcactggcttacgcggaagacagagaggaccttatcgctgggcaagatgtgattttcatgcattttcaacaaccacagcacacttcatggattcttgcctgtgctgacactcaggcttcatcctgagcgttcaccctgacttcttatttgtaatcacacctgaagtcacggtctttctgcatgagcatggagtgggtctctggccaggcctggcgctgtctgcaggtgctgactgaagtagaggaagcaagaggggtggtgggcgcatgactgcagacagtgccaggcaggggctaaagctgccacaagccagcttccttaggcccacctgtcaaggagaagctggccctgctgcccgcctaagacttggggcacatccacttcctcatagtcctggagggagatgagggaacaggttcaggaacaaggccttgagcccagctgtcaaagtaaggagaaggaggaggcctactttgtttttagcctgcaggccatgagttttaggggaaagtgcctgattagattcaaaatttcatgtaaaaataaaaaccaattcagaaacatgcggcactacagc

SEQ ID NO: 2301 - DNA, 700 bp, Homo sapiens
ccacttcctcatagtcctggagggagatgagggaacaggttcaggaacaaggccttgagcccagctgtcaaagtaaggagaaggaggaggcctactttgtttttagcctgcaggccatgagttttaggggaaagtgcctgattagattcaaaatttcatgtaaaaataaaaaccaattcagaaacatgcggcactacagccatgtaccaacaaattatgaccttacattctgactctcagagattaagatcacccattttggggcaagtttggtaaatacgctgcactgtgacccctgtggtttggtttcttttcccctgaacagttagtctattttgctgtttactttcggaatggttaaatctcagagtgtgaggggcagggcgtggggcacaggggccaaggcctctacagggcaggtgtcttgcctgatgccagagtgggcctgttcagccagtgaccagccaacccccaggcctccccaggaagggtggtgcccttctctgggataagagttccctgggctggtcacttggacttccaggtgaacttgagagccattctctggggtgggagccctggagcatcccgggaagcccgtccaggtgtgcagaattccgcacctatgcccggctctcacctcccctctgctctgacagtgttggcccttggatagtgcccaacgcctgggaggcccccg

SEQ ID NO: 2302 - DNA, 700 bp, Homo sapiens
  misc_feature (1)...(700): n = A,T,C or G
tctctgggataagagttccctgggctggtcacttggacttccaggtgaacttgagagccattctctggggtgggagccctggagcatcccgggaagcccgtccaggtgtgcagaattccgcacctatgcccggctctcacctcccctctgctctgacagtgttggcccttggatagtgcccaacgcctgggaggcccccgccccctctccacctccccgtttcctccctnccctgcctcatgggaaggcaggcaccnantggcatttgctcatggttaaaaacaaactagaacnntnnnnnnntagaagcntatttttaataataattattacggtaaaacatcttgaataaatatggaatatgaacttaaataaataaataaataaatattttaaaaatataaatatataaatattactgatttctgtcagtataaaatattcccattcttctgccatgcctgtatcagggtcagtgtngcccagggcaggtccaggccactcccaccatggctgtggcccaccccttggtccctccaagatgaccatcctgagtttctagctcttgtttcatgagagagcagctccccggcttggccagcctcatctggccggtctcactcctggactggctcccagcagtcaaaggggatgacaagcagaaagtccttcaggttctctttgaaactttcaaaggtga

SEQ ID NO: 2303 - DNA, 700 bp, Homo sapiens
  misc_feature (1)...(700): n = A,T,C or G
actcccaccatggctgtggcccaccccttggtccctccaagatgaccatcctgagtttctagctcttgtttcatgagagagcagctccccggcttggccagcctcatctggccggtctcactcctggactggctcccagcagtcaaaggggatgacaagcagaaagtccttcaggttctctttgaaactttcaaaggtgatantctgggttgcacaggaagtttcctttaaaaaaagaaaaataaaaaacacttgagtccaggcaagtgggtaacgtgggggaaggaagcaccagcatgtttctctactgcctcttagaactcagaggccaggaggcccactccaggacacacccactgacctgggtcaggtgacgctgctgccacccacgtgttccccaaggagtgcatagctctgccagtggcagccagagtcaagggcctgacttaagtgccagcctgaggttggccttctgggcagtcaaacgcctgcctttttggtcccagggcagagcagggcagctgagctgaggtcgtctctgggcacccagaaggagtggagtcaaggccacaaactttgctcccttcccgcaggaaggagtgcctgaggtccttgtccattccaagtagcctcccttccttgatcctctgcaantcaagcaccccatgtggggccagaggaaagtcctgccagaaggtgg

SEQ ID NO: 2304 - DNA, 700 bp, Homo sapiens
  misc_feature (1)...(700): n = A,T,C or G
tcccagggcagagcagggcagctgagctgaggtcgtctctgggcacccagaaggagtggagtcaaggccacaaactttgctcccttcccgcaggaaggagtgcctgaggtccttgtccattccaagtagcctcccttccttgatcctctgcaantcaagcaccccatgtggggccagaggaaagtcctgccagaaggtggcacttgggcctgggcacttcctctgggccttgggcaggccccaagtttccttgggtttgccctcacctctgacctcattaaccantaatgacaataatgaccaggataggagcagctcctgctggggagcactgtgggcttcagcgctctgtggctctgactccttgggatgaaatgggctgtctgcctcctctctggagggctaatcattacataactgttggcacagaaaccccctggggtcctgaacagccacagccatagatctctccccatgtcgaccncaccccctagattaagacattcctgctggaggccctgccgtaggcactcaccggggttggagggcagtgctgnttgtagtggctggccatcatggtcaaggggcccttgagcttggtgaggctgccccgcaggccctgcttgtacagctccaggcgggtctgtaggcaggtcggctcctgtggaaaatgtcgttcgtcggtgagcagtggccaagt

SEQ ID NO: 2305 - DNA, 700 bp, Homo sapiens
  misc_feature (1)...(700): n = A,T,C or G
acattcctgctggaggccctgccgtaggcactcaccggggttggagggcagtgctgnttgtagtggctggccatcatggtcaaggggcccttgagcttggtgaggctgccccgcaggccctgcttgtacagctccaggcgggtctgtaggcaggtcggctcctgtggaaaatgtcgttcgtcggtgagcagtggccaagtgcccacagtggtacaagaactctccaccactcctttttgctgctgcccccagcccccaggagtagggcttgggaggggcacaggctgggtccagtcatagaccctgccctgtccatggcaggcacgaacctgcccttctcactgccccgcccaggccaccctcagcggcacctggagaggagcccagccttagggaaggaggtgactctcaccccatcattcagggagaggggggtggggcctcacctggacctgctgggtgggcaagggttgttcctgaaacccctctgtgcctctctgtagtcagcactgtctcaacaggacttggtctcggggcacagtgagcgccccaaacccacagctcctgtctcatgaagtgacccccactttaccacctgtcccctggtgactcctggccattgaatgctaggtctgcccatggccgctcagctgataaaggagctcatgtgactgccataggggcacggccagtagcctct

SEQ ID NO: 2306 - DNA, 700 bp, Homo sapiens
  misc_feature (1)...(700): n = A,T,C or G
tagtcagcactgtctcaacaggacttggtctcggggcacagtgagcgccccaaacccacagctcctgtctcatgaagtgacccccactttaccacctgtcccctggtgactcctggccattgaatgctaggtctgcccatggccgctcagctgataaaggagctcatgtgactgccataggggcacggccagtagcctcttgagcacccagttgctaccccctcctcctgcagccagctgactggagagaaagtggacaaccctgtgtggtgccatctaaaatggagtccccacctccaccccagggcaggggcttctggaaagctatgtcagagagaagcatcttacctggaggtcaaacatttctgagatgacttctactgtttcattctgtagaaaaggaaaatgtcatgttatcaagctgacaggcgtggccagtcaggggccagctgggtggcctaggcacaggcccacattctctcacttaccatctcagcagcagtgtctctactcaggttcaggagacgccgggcctcctggatggcattcacatgctcccagggctgngtgctggggctgggcgagcgggcgggtgcagagatgctgcaggccacagtgcccaagagcagcaggctctgcagccacatcctccagngaactttagcctttctctctgtgtactgggctcactggcaaaaga

SEQ ID NO: 2307 - DNA, 700 bp, Homo sapiens
  misc_feature (1)...(700): n = A,T,C or G
agtgtctctactcaggttcaggagacgccgggcctcctggatggcattcacatgctcccagggctgngtgctggggctgggcgagcgggcgggtgcagagatgctgcaggccacagtgcccaagagcagcaggctctgcagccacatcctccagngaactttagcctttctctctgtgtactgggctcactggcaaaagagctcttaaatacacagaggaaatgattaatggtgaccacaaaatgccagggaggcgggggaactacctgaactgtggaatctcctggcccttatcagccacacatgggaacggtgagccttttccctaggtggtcaggcttgggggttttcattaatgaacctttccaagaaccgacagcccacccacccgccttcctgagggctctccagccctccctgggcagtctgaatgggcctgaggctgccccctccctctgaggggcacagtttggacttcctggcctggaatggctggggtggggcgtgggagacacttagatagggctccccatcctgcctgtaatcccaggggcctttgggcaggctatgcccgccctggtgcctcattctgactccagccttcctcttctctggccactgtgagagacttgagtgtgaggggagctctcacagacctgccccactgacagttcacatgggctcccacccaggacctgga

SEQ ID NO: 2308 - DNA, 700 bp, Homo sapiens
gggcgtgggagacacttagatagggctccccatcctgcctgtaatcccaggggcctttgggcaggctatgcccgccctggtgcctcattctgactccagccttcctcttctctggccactgtgagagacttgagtgtgaggggagctctcacagacctgccccactgacagttcacatgggctcccacccaggacctggagcagggggcaacctcagtccagtaaggggggacccctgcccctgtgagcagagggaatgaccaccatgtgcacatccagcagcgagactgcagccactctcagcaagcttcagagggggtgtggctgggtcaagtcgggacccagagtctgactcttggctctggagccaccttcctgagtgactcccctctctggttatgtgaaccttgattccctctgcagagcaggtttgcccctctgaggttcggactacactcctatatgtagcccccagaagacaccaggagcttcaggctggctccagggctgtggctgcatccatctcaggtacagggacaatggcttccccagcaaggccctccaggcttaatttcctacataaccccagcatcccccaactccagaggcctttctgtggaagtgtggaagtaggaaatctaaaggctcttgaggggctgacaagtgtttgattttcacaatggagttcagagaagacagc

SEQ ID NO: 2309 - DNA, 700 bp, Homo sapiens
tccagggctgtggctgcatccatctcaggtacagggacaatggcttccccagcaaggccctccaggcttaatttcctacataaccccagcatcccccaactccagaggcctttctgtggaagtgtggaagtaggaaatctaaaggctcttgaggggctgacaagtgtttgattttcacaatggagttcagagaagacagcacgagtttgtgtttgcacaaggtatctggctcaagctgccccatgcctgggtttcatagctaaaggggtgtgggcccacacgtgcccatttctgggtgtatgtgtgctgctgtgattggttgtacatacaggtgcctggtagaggggaggatgttttccatgcagatgcatctattgagtcctcttacctgctttatgaaaggctccaggcctctgaaggtgactctgatactggagaagctccctactccaggtgcagtgcctctgggccctagaggctgattcagcctaaaccagtggggttggacacaagcgagaacattctgctggactcaggttggcgagccttcagagagcaggtggagttcatggctttagcactgtggtctgagtctgcagccctggccagtttccctgtactgtgggagtttttctgaccttgcatagagaaaccaaaccttagtcctccagaccccactgtgaggccagccccatccatc

SEQ ID NO: 2310 - DNA, 700 bp, Homo sapiens
ggttggacacaagcgagaacattctgctggactcaggttggcgagccttcagagagcaggtggagttcatggctttagcactgtggtctgagtctgcagccctggccagtttccctgtactgtgggagtttttctgaccttgcatagagaaaccaaaccttagtcctccagaccccactgtgaggccagccccatccatctgagcctgcgtagaacactcctagtggccaggctggggtgggaacatgaaatgtccaggccctggccctttctccaccttttttgcaaggccttggctcagctctttccagggagctctcgggggagagatgaggacatggatactacatgtagatatcacatgtgttggatagcaccctggaggctggagggcagggaagggagccatagatagtggttcagctgatggccagggaggcagagagcctgtatgacccatctgggagagaaggtcactttcctcctagaaatgagttgtcatagctcagacagtcagtcaacaagtctttccaatccacaccaggacctgttctggggaggtaaacgggaccctcccactggccctcacatttggcccttgaggctcccagtctggtaggaaacagactgcaatggaccctcccatggtgtgaccttgactcggcagggggaagtccagagctgagggatcccagagggc

SEQ ID NO: 2311 - DNA, 700 bp, Homo sapiens
atagctcagacagtcagtcaacaagtctttccaatccacaccaggacctgttctggggaggtaaacgggaccctcccactggccctcacatttggcccttgaggctcccagtctggtaggaaacagactgcaatggaccctcccatggtgtgaccttgactcggcagggggaagtccagagctgagggatcccagagggccaccttctctagcttggggatccaaggggaccagagagcttcactagagatcctgcctgcaagcccaggctgaaaggctagaagtcaggtgggtacgttgggttggaaggagaggggcaggagaggacaggggagaatgttctgggcacagggagccctggggttttaggaatgggtataaggaacagcaggcagactccagagagattgaggaggtagaatctcaacaggacttggtgctatagtgaagtcactcagtcattcattattttttgagcatctactaggttcccagcagggaaaagggacataaggatgacaaaatcggtcagggtcctgcctccaaggactttttaaccccatccatggaggagcaagattagtctactcacccccctccccccccaccaaagtgtgctctgaatgtgagtaagaggagttagaatcactgtccacatggctaaggtgaggacccaggggacaaaggagcagatcttcag

SEQ ID NO: 2312 - DNA, 700 bp, Homo sapiens
aaaagggacataaggatgacaaaatcggtcagggtcctgcctccaaggactttttaaccccatccatggaggagcaagattagtctactcacccccctccccccccaccaaagtgtgctctgaatgtgagtaagaggagttagaatcactgtccacatggctaaggtgaggacccaggggacaaaggagcagatcttcagagcgtgaggcccacgggaagttttggagtttcagagtctgcatgtacaggagacagatctggcagcggtacatgtctgtgtggtagctgaggccacggaagttattcaggaagaagagctgagggccagcaaagctgtgtttaagggctgggacataacagatgggcaagtaacaggccagtggccaagggcctaggagggaaggaaaggaggaaagcaagagtcataataagaaatccatttcggcagtggtggcctgcaggtgcccaagtcagcacaaacaggacagaaatccatgggtttggtgatgaggtttgtgggcagccacacatctttctcatggaaagatgacatcagggctgaggccatgacacaggcaggcattcctagattgcactgtattttaaacagtgtcaaccgatagccagccatgctgactcaggggctccgatggggctgtggcagggcagaggcggggaccacgatgggtggtatgaccc

SEQ ID NO: 2313 - DNA, 700 bp, Homo sapiens
  misc_feature (1)...(700): n = A,T,C or G
tttggtgatgaggtttgtgggcagccacacatctttctcatggaaagatgacatcagggctgaggccatgacacaggcaggcattcctagattgcactgtattttaaacagtgtcaaccgatagccagccatgctgactcaggggctccgatggggctgtggcagggcagaggcggggaccacgatgggtggtatgacccctctggggccccccttcctacagagacaggngaaaaccctctggaaggagtttcctatgcgtgtccaccccacaggctctgtaggaaacaggggcttgagtcactccaggatccttatnacgagagacattatcacaaggggaaggaaatgggcctcaaagtcccttcggtaccatggcacccccgcacaggctttggggctgatctgatccttctttgacctgtccaacccttgatgagggttcttgttatctctggggacctgagatctgggagaccagtggtcagcccagtccacacaatcagtgaccgcagaaccagaatttgaacccatatctgttcctgctatcctagcattttccattgtcttggggtcaggaagttgggaaatgctgatcacctggctggaccagcagggggtggacccagcgtgcttgtcccctcaaggcagctgtaaagagagatgcctgccaggtgttcgcaggtaggctggagtggcc

SEQ ID NO: 2314 - DNA, 700 bp, Homo sapiens
aatcagtgaccgcagaaccagaatttgaacccatatctgttcctgctatcctagcattttccattgtcttggggtcaggaagttgggaaatgctgatcacctggctggaccagcagggggtggacccagcgtgcttgtcccctcaaggcagctgtaaagagagatgcctgccaggtgttcgcaggtaggctggagtggcctgtgactgtcccagggaagtctgggctgaaggcagagtttccccagcagatcctgccatccaggcatctctatgccccaggcttgggctcttgcccttacccagccaccaccaatccctgaagcctaggaaagtccctcctccctgagcctcaacccctgcatctgtacaatgggttaatggccactgcctcaccgaggaaactgttgcctgccccaggaaactctgtgggagatcctcccagggaagagacaatccttcaatttctcctctgcccagtgctaggggagatttctgaagcccaaactgggcagaggagcgaggcctgctggagtttccagggacagctgccccttgcccagccctagccgcagagggcaaccttctggacacacgtggtgaggtagggagtccggcctccacctgagtcagggctcctgggtcctgcatcaccgacaggagatcctggtaccgcatggcaccatgagtggtttgtccttc

SEQ ID NO: 2315 - DNA, 700 bp, Homo sapiens
ccaaactgggcagaggagcgaggcctgctggagtttccagggacagctgccccttgcccagccctagccgcagagggcaaccttctggacacacgtggtgaggtagggagtccggcctccacctgagtcagggctcctgggtcctgcatcaccgacaggagatcctggtaccgcatggcaccatgagtggtttgtccttcccttgtcactccaggccacaccagacatatgaagcaacatctctggcttctgcggtttcagccccattctgtccccacgtgcatcccctctgtctcggtccccaaatgtacacctcaaaaagggaagctgccctcgccaagctccaattccagtttggcctcttggtattcccaggttcctggcactggggagtgccagggaggcctgggaggatctgagggtggttaaccctcaaccacatgtggtctctgcatctattcagccaagcttccgggagggtttgctgcggagtacgcacctcacaggccccttgcactcggagagctcacttctggtggtcccatggggtgggggacagggagcacaaggcccacactcataggcagagacatggagaccatttgctgtgatgggggagacacaaggtcacagggaggtttgagaggtcagcccatgttgcactggaatggcaagtttgagaggccaggggacctccagg

SEQ ID NO: 2316 - DNA, 700 bp, Homo sapiens
tcacaggccccttgcactcggagagctcacttctggtggtcccatggggtgggggacagggagcacaaggcccacactcataggcagagacatggagaccatttgctgtgatgggggagacacaaggtcacagggaggtttgagaggtcagcccatgttgcactggaatggcaagtttgagaggccaggggacctccaggaagactcagtcagttgtggccatgtgggtccggaagtcagggcatttggaagtcactggtaaagaggaggctcccaacaccagaggggctgtggagagtgagccaggcagaaagtagtggcggggtgtcaacttttgaggatggccaaggacaatgagacctccttgtttgcttctttgttcttggggcttcctttttttccctcaggatctggcaactccaccatgcacatcactcaggcagaggagtccttgtggacacaaacgcccaatgggtgtgccaggccttcccaccacagtgccctccctgacctgtgtctactactcgcctggtgtactccctctagggccagaaatgcatcccctgctcctgagtctctgctctgagcctcatctctggctgggaggatcatcaggcacccagaggggccacagcctatgtgtgccctcttgggaagagccatcgggaggtgcattaaaaatcaaaagcaggagaaatca

SEQ ID NO: 2317 - DNA, 700 bp, Homo sapiens
ccctccctgacctgtgtctactactcgcctggtgtactccctctagggccagaaatgcatcccctgctcctgagtctctgctctgagcctcatctctggctgggaggatcatcaggcacccagaggggccacagcctatgtgtgccctcttgggaagagccatcgggaggtgcattaaaaatcaaaagcaggagaaatcatgagaccagaagcctgtataatttctgaagtcctgcaggcatccgttcctgccctctatgtctggagctagagtctgggtcaagatgccaggtggaagtcccaggcccttgcccggctcgcgcacctgcatccccctggaactgatgggtcagaattgaggtggcagatgtgggctttctgctctcagcaggacgagtggttctggaatgagcctcctccaagactcttctggatccctcacgggtccctcagactttccctgaggccctgtttgggcaggcacagctcgctgcatgtccttggcctgtggcctgccccttctgagccccggctggctcaccccacagggcatgcagcactacttttgcaggctgttgggagatgcactggatatctgcaagggaaggtgtttctgttttggttttctgttttggcttgctaggtgcctccatctagcctcagtctcgctgtccatcaaagagagggaatggttaccagg

SEQ ID NO: 2318 - DNA, 700 bp, Homo sapiens
ttggcctgtggcctgccccttctgagccccggctggctcaccccacagggcatgcagcactacttttgcaggctgttgggagatgcactggatatctgcaagggaaggtgtttctgttttggttttctgttttggcttgctaggtgcctccatctagcctcagtctcgctgtccatcaaagagagggaatggttaccagggtccggaccagcctcccagccttctcattccctggaggtgagtgtaaatttaggtttccctcatgggaagtgggcctgtgtagacccctccccagggccctaaagcctccccaccccagccccaggaggcaaacgccacctgcatcctggtgctcgagcctgactgatggcaaagtggctgagccatacagattttccagaaagagccagcttggaacaccaggacagggaaccatcctcctcagtctttccacttgtcctggtggggaggaggtggtccaaggctgccaggggcagctcttgagtctggccatcagcctgggagagcaggggagtcatgttgatcacagacccactgcatggggacatcctccctgattcaaggctctctgaatggtagtggcggctgcccagtgtttttattccttatgctcaggagggcctcggcccagcccatgggatcaggacacagagcaggtgcgcagctggtgctcacgaag

SEQ ID NO: 2319 - DNA, 700 bp, Homo sapiens
ttgagtctggccatcagcctgggagagcaggggagtcatgttgatcacagacccactgcatggggacatcctccctgattcaaggctctctgaatggtagtggcggctgcccagtgtttttattccttatgctcaggagggcctcggcccagcccatgggatcaggacacagagcaggtgcgcagctggtgctcacgaagggaggcagggaaggagacccctgctctgctgctcggccttcgctccggcgcccgctgccctccgttgcctccccacagctgtcctccctccctgacaccctgacttggcccctcagggcacacacatcatccacacagcctgctgtccttgctgcccgctgatctccagcacagcccactttccctccaggaaagggctgagtctccaagtgcaggccccaggcaagtctctgccaaagcaggtcccgggagcaccctgggtcaagggctcatgagtctgaggaggagggaaggaggcctcacaccagaaggattccatggaccccacagggcagggagggctcatggaagggaaagggaaggggtcactcatgagccatggctggaggtagagttgagcttggggtctttggggagcctgagtgggagctggaggaggccttgacaaccagccatggcaggggacagctgggagccagggtctctctcagaagttcctt

SEQ ID NO: 2320 - DNA, 700 bp, Homo sapiens
cacaccagaaggattccatggaccccacagggcagggagggctcatggaagggaaagggaaggggtcactcatgagccatggctggaggtagagttgagcttggggtctttggggagcctgagtgggagctggaggaggccttgacaaccagccatggcaggggacagctgggagccagggtctctctcagaagttccttaaggcatggggacagagacaaagaggagcacagaggaccacctccctggatctaagcccccaatgtgtgtgttggttgtggggagggggtgccaggtaggaggacaggacagatgggcgtgtagaggcatttactgggcaatatgagagtggtcaggtgagaagcatggagctgaggcgctaaggctgcgctgctcactgtgggcctggaaccaggaggttgtagggcagaagttaacacgggaggcttggatccagtcaaggggagaccccaggcacatccagggtcagacttaaaagaattcctgggcctcagtgggcattagtgaaccactgttgcttaaggattcagaggctctggactcaaataaccttcatttttctgcctcagtctctgtctgtgtaatggggataatcacagcctgggtgcctgggtcattgtggggattctttgagtcccttctcagtccaggagggcagcagcaactttgctgacccacc

SEQ ID NO: 2321 - DNA, 700 bp, Homo sapiens
attcctgggcctcagtgggcattagtgaaccactgttgcttaaggattcagaggctctggactcaaataaccttcatttttctgcctcagtctctgtctgtgtaatggggataatcacagcctgggtgcctgggtcattgtggggattctttgagtcccttctcagtccaggagggcagcagcaactttgctgacccacctcgttgagcttgacctgaggctttcaagggggaaagttgggcccctagcccccacccctggtccacaccacctctgcctcctctccctctctcccaccatgggtcccccatcttcctgggcccagggattcccctctgctggaccagcccctatttcctccagcacctctctccctctgcccttgctccttcttgttggtgttaaacacacagtgtctgccatggctccatcctgtccttccgcctccctccacccacccctcctcaggccacagtcatccagtcttaccgtctccacagcggccagtctgggctgggctggcctgggatcagagagggaggaatggggagaagagactagctaagacccagaggtgcctggggcccaggctggctgggctccaggggcaaaagcagtgacccagggcacagccttcaccttggacacttggcacccagccacactctggcctctccactgcttagtctctcctgtgcct

SEQ ID NO: 2322 - DNA, 700 bp, Homo sapiens
cggccagtctgggctgggctggcctgggatcagagagggaggaatggggagaagagactagctaagacccagaggtgcctggggcccaggctggctgggctccaggggcaaaagcagtgacccagggcacagccttcaccttggacacttggcacccagccacactctggcctctccactgcttagtctctcctgtgcctccgcttaccttgtcttctcgacctccatgccctcctcccccagggcatctgcctccttccttccctgtgcttttcccacccttctctgctggatgaacttctctctcaggccccttctgtgccacccatgggcagtgcctccgatgaggtccacgcccatccatcggtcctgtgctgtctgtaatgacccccaccgcactgtgctgggccaactgcacaaggccaggaggcctgaaaggcctggcccagtgtctcacctatgcccgccccagcctgggggagccgtggagggtcctcagagcagttgctccactgagtcaaatgggggcttgagtccagggcaggaggaacagagccccttcctggagtgggaggattcctgtcaaggggtgaggcttgttgtgccttctgagttctgccctccttaggcacttgcctttctgtcaattttccctttgttttatttttctgcatttccaagtttttcagtaaagagtata

SEQ ID NO: 2323 - DNA, 700 bp, Homo sapiens
gcagttgctccactgagtcaaatgggggcttgagtccagggcaggaggaacagagccccttcctggagtgggaggattcctgtcaaggggtgaggcttgttgtgccttctgagttctgccctccttaggcacttgcctttctgtcaattttccctttgttttatttttctgcatttccaagtttttcagtaaagagtatatacgctttcccatcttctcctccaatgaaaaacaatagtttttgttttttttttttgagatggagtctcgctccaacaatagtttttaagtgaaaaataaaattcctggctgagagctgtaatccacctttcccctgagcagacacctgggatgtgggaaggcaggaacttgggccttctctggtggttctgggatttataatggggcgatgctgccccctggcgccatctggacacacagacctggcccaaaggacaggctccacatcctaatgccatcacagtggggattcaattttaacatacaaatttggagggaacataaaccttctgtcaaagcatgtagaaattcccccagcctgtccaggaactgactgccacttggttctggccccagtctggctttaagctgcagtctatactattccagaaggtcagcgaggagcccccagcgcatctgaaaaggtccgcccactgccctctccagcatgtcacctccg

SEQ ID NO: 2324 - DNA, 700 bp, Homo sapiens
acatacaaatttggagggaacataaaccttctgtcaaagcatgtagaaattcccccagcctgtccaggaactgactgccacttggttctggccccagtctggctttaagctgcagtctatactattccagaaggtcagcgaggagcccccagcgcatctgaaaaggtccgcccactgccctctccagcatgtcacctccgcgtgccaccctccgccagcgacaggtcctgacgactggcctcgtgcaccaggtctgtgtctgatccagccactaaccctgcctcttgcaggcatcagtcactaacacaggaccagcagaggagacagctgctgacccactctccagggtgtgaagaggaggtggcaagcagcgactcatctgggaacatggggctggggcacaaatgctgcctcagcccaggatgaaaacaggactagctgtcacgtgcgagagggagggaaagtgagggctggggggagctgggtgtgcaggagacttgggaaacccagtccagagtcagacctctcaccctaccctctcaggcctggctcctccaggacctctgaagtgccctgagaccagtggcacacacctccccctagtggtcaatccagaaactgcagcagcatcctctgtatctcctcccaggctaagtccaacaacagacatcccctggtccccaggcaatgccctcagtga

SEQ ID NO: 2325 - DNA, 700 bp, Homo sapiens
ggaaacccagtccagagtcagacctctcaccctaccctctcaggcctggctcctccaggacctctgaagtgccctgagaccagtggcacacacctccccctagtggtcaatccagaaactgcagcagcatcctctgtatctcctcccaggctaagtccaacaacagacatcccctggtccccaggcaatgccctcagtgagccaggctggggagaggtggggggagggggaaaagagagttcttctgtgggaacataacgattttttagggggaagaatttagggaaatagagttctgagcctgtagcagataaatcttccatcatctccagtcccattcaagcagccgggctgttccttattcataacctcaagggagggatggatcaaggtggaaaacaggaaaaagggggacaggacccctgcacctggtgtcagcctctgacgcttttctgggacttgagaggaatcagagaggatgctattgctgcttacgtggtgacagaggaaggcccctctgcccctccttccactggcagactgagtagggccacagggtggtgtgcaggggagttagaggggggcactcagggctaaagggccaggtggtagactgaagccacactcgggatgtcccagcctcctgccttctgcctccaggctggtctgcaccacctccgtgccacagtggctgtccctc

SEQ ID NO: 2326 - DNA, 700 bp, Homo sapiens
gacagaggaaggcccctctgcccctccttccactggcagactgagtagggccacagggtggtgtgcaggggagttagaggggggcactcagggctaaagggccaggtggtagactgaagccacactcgggatgtcccagcctcctgccttctgcctccaggctggtctgcaccacctccgtgccacagtggctgtccctccagtgggtccctgtgtacccacctatttcggaggagggccccatcctgggatggtgtggacagtccagaggtgggcagagtttgagttggtccatggaataggaactcatcaagccaagtaagggcatgccagactgaggtgacaatgtggatagaagctccagggcatgaagagaggcttcatggaaggctgtctaggaagtcccagcactcctgttggctggagcattgattagggtggtagccatgggggaaacagaagcaacagatggaggtgagccttatacgttgtcctaaggatatggacaaggtccagaagaccccgaggactgggggattcagtatagatccacatggtcagatttgcattttctaaaactccatctggctccccagtagagcacagatcgtcagggtgtgggttccagggctggccgggaggcctacagggtggctgctaaatcatcaggcaggagaggctgggggcttaggcaggggtg

SEQ ID NO: 2327 - DNA, 700 bp, Homo sapiens
tatggacaaggtccagaagaccccgaggactgggggattcagtatagatccacatggtcagatttgcattttctaaaactccatctggctccccagtagagcacagatcgtcagggtgtgggttccagggctggccgggaggcctacagggtggctgctaaatcatcaggcaggagaggctgggggcttaggcaggggtggagactccaggcttggagggttttaaaggaatggaatgaagaattgggtggcttgtgtcagcagaacctgctgccttgagggggtcaggggatgttgatccctgatgttggccctgggaggagcaggggcggcggctgcagtttctggaaggaccactagggggagacatgccacaggattagcatgctccagaccacagggacctgaattcaagccccagctgggccactatcagcttaggcagttgctcaaccaggccgaacttcagtttcccatgaaacggagaaaacatactcttggttggggtgaggaataagttagatagcataggtaaaatgctcagaacggctcctggtacctggtagcagttctgtggattttcaagattgctagggttatcatcacctttctggaaatgggggtggcaggagggcagtgtgagaacaagctcacccagacagcatccacgtggcaggatcaagccacccaggatttgtgg

SEQ ID NO: 2328 - DNA, 700 bp, Homo sapiens
  misc_feature (1)...(700): n = A,T,C or G
gttggggtgaggaataagttagatagcataggtaaaatgctcagaacggctcctggtacctggtagcagttctgtggattttcaagattgctagggttatcatcacctttctggaaatgggggtggcaggagggcagtgtgagaacaagctcacccagacagcatccacgtggcaggatcaagccacccaggatttgtggcacaccagtctcccttaaaatggtcactaagtcccaagtcaaattgagacactggtaacaaagcagttgttcagagtctagtttattctcacacatccctaggaaccagtttaaaactcgaggtacaaatgaacatgctccccaccccactctgagttttttgcagaagcagcaggacatggctcctctgctaaaataaatacagttcacactccaggcaataaataaataaatacatacatacataaataaatagtctcaatgggataaaaatgagaacacaaccgcacaaggccaaatgggagctgcacatttcagaaattagataattaacaattcatctgatgccgcaggaaaaggtgaaatgcttctggtcctggaatgtgtgagagatgacccagaggtttcagaagttctgctgtttttgatgtcccgaggcnctgtggtgagaaggcccagagaacgagctggacgttggactnaaaagatcgcgaggctca

SEQ ID NO: 2329 - DNA, 700 bp, Homo sapiens
  misc_feature (1)...(700): n = A,T,C or G
gggagctgcacatttcagaaattagataattaacaattcatctgatgccgcaggaaaaggtgaaatgcttctggtcctggaatgtgtgagagatgacccagaggtttcagaagttctgctgtttttgatgtcccgaggcnctgtggtgagaaggcccagagaacgagctggacgttggactnaaaagatcgcgaggctcaaagtcgtctgttgagcctgcgcattctcaagggttttcagatagaacgtcagtttcctccggaattcattccagtcaccgtccttgatatggattggatgtcgctataaagaaaccaagaaggtggcattaggtgagtccaggctgtaatggtgatgaccagctgaggagcaagccatgacgggcatcttgggggacagcttaccgtgggtgcggccgtggccaggggcagacatggcaggagattctgtggaaagagaccaaagcagatggtcagagattcccttggaaagggagtgggccctgctctcctccccagaggcagggcagggccaacacagggatcccaaaccctcaacagcttcacatactttaagaatgctctcaattgctgatgcgttctgtaaactcttgacagccctgttgaatgcctccaggtttggccttcgaaggttattttcctaacggggcagagaatacacttaagggggaaaggttaca

SEQ ID NO: 2330 - DNA, 700 bp, Homo sapiens
ccctgctctcctccccagaggcagggcagggccaacacagggatcccaaaccctcaacagcttcacatactttaagaatgctctcaattgctgatgcgttctgtaaactcttgacagccctgttgaatgcctccaggtttggccttcgaaggttattttcctaacggggcagagaatacacttaagggggaaaggttacagagtatccctcccacaagcaggtggaagtcacccccacagtttcccaagcccactgttggggacatcctcgggttccctcctagtcccgttcttgcctcaggtgggtccctgcccaagggcacaggcctagaagtgagtggcaggcaggacctggtttcctcaagcccccagtctctggctccatttgagctacataaagggcctaggtgggctgggcgcagtggctcaagcctgtaatcccagcactttgggaggccgaggcaggcagataacctgaggtcgagttcaagaccagcctgaccaatatggtgaaaccccgtctctactaaaaatacaaaaatgggagtggtggtgcatgcctgtaatcctagctacttgggaggctgagacaggagaattgcttgaactcaggaggcagaggtagcagtgagctgagatcgtgccactgcactccagcctgggcaacagagtgagactcttgtctcaaaaaaaaaaaaaa

SEQ ID NO: 2331 - DNA, 700 bp, Homo sapiens
accaatatggtgaaaccccgtctctactaaaaatacaaaaatgggagtggtggtgcatgcctgtaatcctagctacttgggaggctgagacaggagaattgcttgaactcaggaggcagaggtagcagtgagctgagatcgtgccactgcactccagcctgggcaacagagtgagactcttgtctcaaaaaaaaaaaaaaaatgggtggggagggggtacctaggtggatctttctgcacttgggggaaaaaatatctccaaaaagaagctctacaaaagacagggggttttccaagggaagtatttgtagctcagaggctgataacagtgttcatgccctgactgaattaaagtctcctagaaatcaagaagaaaatcacagagaccccagcatggaaatgggtgcagcatgtgagctgtgagtgccccaaacacagatggcccaggaactcagcaaaggtttccacttcttgtttgacccaagaaatgtcatgcaaaggtgagacagaacaactgcaaccaactggaaccatgaaaaataactgtaaatgataatgccacagccaatgagggtggaaaacacaaactcaattttttaagggaaaaagaagctggcacatctgagggggaaatttctgtctgtcagtccagagtctgccctaccaaacactgaccttaaggcccttggtattcctcacc

SEQ ID NO: 2332 - DNA, 700 bp, Homo sapiens
  misc_feature (1)...(700): n = A,T,C or G
gtgagacagaacaactgcaaccaactggaaccatgaaaaataactgtaaatgataatgccacagccaatgagggtggaaaacacaaactcaattttttaagggaaaaagaagctggcacatctgagggggaaatttctgtctgtcagtccagagtctgccctaccaaacactgaccttaaggcccttggtattcctcacctagaactgccttttcattttctaatttaaaagtcattttcattattatagccatggctgtggccatgtattgaactcttaagtgccagatgctgggccagaacatgcacattgtgccatttgattgtcataacaatcccactgagataggtgctattaaccctattttacagatgaagaaagcaaggctaggtaagatggaatgacatggctgaagtcacccaggcaggaagtggatcgggatccacgggctgagctcttaccatcagaatgtcttggtcttccccattgaggttgttgaagtcctgtgggggtgaagggagagaaaggcccatgaggccttttggccttaggcagccaccacccctcactgctgcaggccagtcttatccaagctactcaccagcaaaggcaaaggtggctgctttaagtgtgttataatttcatcgatcatgttagagcagttaacccagcttgtcttcaaggncgttgtctgggtca

SEQ ID NO: 2333 - DNA, 700 bp, Homo sapiens
  misc_feature (1)...(700): n = A,T,C or G
agtcctgtgggggtgaagggagagaaaggcccatgaggccttttggccttaggcagccaccacccctcactgctgcaggccagtcttatccaagctactcaccagcaaaggcaaaggtggctgctttaagtgtgttataatttcatcgatcatgttagagcagttaacccagcttgtcttcaaggncgttgtctgggtcatgggagcttggagtccggggcggaccaggagttggagcaggagcaggacgggcaggcggctcatgtttggatcggcaggaggcactctgtcttgttctggtccttcgtggggctctgaagagttggcaacaacctcccgccttatatgtgcagcagcaaggtgcccacaaccccgggcaaggcggggggaggtggtggtgtggggcaggcgtcggaaggatctttatctgacatggaacctccatagaaaaccacagacgtaattattcatccatgactttctagtactcaagatcagtgaaacaagaaaaaagattacttaaacgttatcacttcatcttgtcaaggaggatgagagatgggaagcatggcagcaggtgagaggacccctgtggcaggaaggggaagcctgactcagctcactgaggcctcctgcccagtgggatctcatctgccatcacctggactaccctggccctctgctgcccgccctgcttggt

SEQ ID NO: 2334 - DNA, 700 bp, Homo sapiens
aaacaagaaaaaagattacttaaacgttatcacttcatcttgtcaaggaggatgagagatgggaagcatggcagcaggtgagaggacccctgtggcaggaaggggaagcctgactcagctcactgaggcctcctgcccagtgggatctcatctgccatcacctggactaccctggccctctgctgcccgccctgcttggtcctggtgggtggccaggaggccactggaacagatgagagtttgtctggtagccggtcacgctgctaaacatccacgttcagcctcaggctctgagaagcacatctcttggtgccgcttcccaatacagaattactggtgttccagtccccagtggtttgtcccatgggcttcgggcagcttctccttgacactttgtttctggtggatggccgagggcgctcaggccccaggtggccattctcttactggtctgctagcagtggcatggctgttccctgcgtgtgggactcagcctctgcaggaggcccggctgcagcccctggcagtccctctggtagcaccgagagctgagctcaggtacctgaggacactgtcactgggagctgggggaggggctggcctgggaggtttaggaggcagaattggcatggtctgaggggtgaggtcaagggaggagaaaggagagcaactccctggtttcagactgggcctcaggctg

SEQ ID NO: 2335 - DNA, 700 bp, Homo sapiens
aggaggcccggctgcagcccctggcagtccctctggtagcaccgagagctgagctcaggtacctgaggacactgtcactgggagctgggggaggggctggcctgggaggtttaggaggcagaattggcatggtctgaggggtgaggtcaagggaggagaaaggagagcaactccctggtttcagactgggcctcaggctgctggggcagggattggcaggagacagttgtattgagaggtcttgatccccgtctgtgctgagcatggatttgccaggtgcaggcccagtaggcaaggtttgcagagaggggatgtgagtggggacagaccatggggaaatccacaagggacctgagaaactgcagccagataggaagcaggaaacccagaagggcgggggtggttatcccagagggcagcccctgagagaagaggggtcctcctgatacgggcctgtcttggggcctgcctgacccaccccatggggtaggggcttttggtaaagggatgagtgtgacaggggcatgtggaagacttcttcaagatgattggccccgggtgggagggagaggagagcagtaaggaaaggccagggtctgggtcatggtgcggtgtgttgtgatcagtgtgggggatgcgggataggaggttatgctgaggcagcggaatttgggtgctttgggcttctgagcataagcag

SEQ ID NO: 2336 - DNA, 700 bp, Homo sapiens
taaagggatgagtgtgacaggggcatgtggaagacttcttcaagatgattggccccgggtgggagggagaggagagcagtaaggaaaggccagggtctgggtcatggtgcggtgtgttgtgatcagtgtgggggatgcgggataggaggttatgctgaggcagcggaatttgggtgctttgggcttctgagcataagcagatcaggtgaagacaaggaccaggatgtggctgtggggaggcaggtgaagaggctgtgactcaaggccatgctgtgaggatgatttctgtagctgatatgccctcctggctcagccccaggctgggccctggaccaggaagagccctaggttctggacccggagtggagtctgacaggcacaactcaacacacagaggggagccttagcaccagcttgcgtactccgtaggcacaattcattcaacagacgtctacaaagcacttgctgtgaataaaacagacatggtaacctccactagcagctcagtcttgtgaggagacagatttccagtcttgctacccttcctgtggtcccagacctgcaggtcagccctgcccgggagcttgttagcggtgtcaaccctcaggccccagcccagactttctgaatcaaaaatcgcattttgataagatcctcagtgattcagtgcatttgaggggctctgatctaactacctcag

SEQ ID NO: 2337 - DNA, 700 bp, Homo sapiens
agctcagtcttgtgaggagacagatttccagtcttgctacccttcctgtggtcccagacctgcaggtcagccctgcccgggagcttgttagcggtgtcaaccctcaggccccagcccagactttctgaatcaaaaatcgcattttgataagatcctcagtgattcagtgcatttgaggggctctgatctaactacctcagcaatcttagctccggtagggtcccctattgccccacggacccagagtttgttccttgcatactcaactgtaccttggtgttactgtctatgtaaacgttttggggacttgtgcacaaataatgtgattccttacagagaaaagctgtattttttttagtgtaagtgggcttttctagggaattttaaagttcaatgaatttaaagctgtggagacaaaacattcctgtatttttttttgtttctttaaaagtcaagactttgtgttgtaaccacacatgcacacaaaatcctgaatagtagtattgtaaatcttgacatttgtagtgtttttctcattttaaaaatgaatatataccagcctgagcaatttggcgaaacctcatctctacaaaaaatacaaaaaattagccaggcgtggtggtgcacacctgtggtcccagctacttaggaggctgatgtgggaggaccacctgagcctgggaggtcgaggctgcagtga

SEQ ID NO: 2338 - DNA, 700 bp, Homo sapiens
gtattgtaaatcttgacatttgtagtgtttttctcattttaaaaatgaatatataccagcctgagcaatttggcgaaacctcatctctacaaaaaatacaaaaaattagccaggcgtggtggtgcacacctgtggtcccagctacttaggaggctgatgtgggaggaccacctgagcctgggaggtcgaggctgcagtgagttgtgattgtgccactgcactccagcctgggcgttggagtgagaccatctctccaaaaaaattatatatatacacatagtttattaaaggcaaaagaggttgaggcttcatgctaggagcattggaggacttgcggggttttcaaccaggggaggcgaggtgaagctcaggtgcacctgctgtgggggaaaggatgagaaagttcaaggcagcagggtggccagtgaggagatattgggagtcctctggaagacaggtggtgggaagctggactaggtaggttcttacggggtggagaggactgggtgaagggaagcgctctcacagctgacttctattgagtggcacttgtgaagtgtggagaactaagttcttttcatggctgaacttgttaatcctcatgatgaactgtgaggcaggtgctgttattagccccattttccagatgaagaaactgagtctcagagaagctgagctgatgtagctaggaagtgacatc

SEQ ID NO: 2339 - DNA, 700 bp, Homo sapiens
gactgggtgaagggaagcgctctcacagctgacttctattgagtggcacttgtgaagtgtggagaactaagttcttttcatggctgaacttgttaatcctcatgatgaactgtgaggcaggtgctgttattagccccattttccagatgaagaaactgagtctcagagaagctgagctgatgtagctaggaagtgacatcactgggactgagataagcagaacagtccaacccagaggctgagcaccccctgggcagcatcggacaatgacggccttaaaggatgatgccatgtggcaggaggggacagcagggtgaggatgagatgtaaccactctgattactgacggggagatccctgaggcctctggcggagtagtttcagtgtatggtggggcaaagcctctggcagtgggctgagaagcgagtgacggtgagacggagggtagaagattctttgaagttttattttgaaggaaagagggggatggggcagccagaggagtcacagggtcagagacgcaccttccacacagaagtttgagctccttcctctcttaaggaggtgagccgggaatgggtgagatggctggccggccagcacaggcagagccccaccatcagctgtcacgggctcctcgcagagagctcagggaagggctgcctgggtggcccagtccatctgggtggggtaggtgcag

SEQ ID NO: 2340 - DNA, 700 bp, Homo sapiens
  misc_feature (1)...(700): n = A,T,C or G
ggagtcacagggtcagagacgcaccttccacacagaagtttgagctccttcctctcttaaggaggtgagccgggaatgggtgagatggctggccggccagcacaggcagagccccaccatcagctgtcacgggctcctcgcagagagctcagggaagggctgcctgggtggcccagtccatctgggtggggtaggtgcagtggggtgggcctggttggtccacaggtttgtggtgggaggggacaatggcttctgtgttctctgtgaaatagaggtcaagtcagcccctgaggtggggctagaagcaataagggtggtgaggtttggtggcttgagctgtgactacctggaggtgaccttgaggggctggcagcctggggtcagagggcgaggaggttgggaggacccagggccttggcaggcaagaatatggaatggaaggccccagaggcagggagtggggccatgggaggaggctgggatgggcagggaggccagctgggcagagcaaaggaggcaggaggtggtgcagccccggaccccggagaggcccagtgactgcagcccaatacctgctgccgttcgatgaaccagggaggaatggagggacatgttcctaaaagcaaacctcattccaaaggggctgccaaggatatctgggtagttggccaccacagcgcttcngtgagcccttggaccg

SEQ ID NO: 2341 - DNA, 700 bp, Homo sapiens
  misc_feature (1)...(700): n = A,T,C or G
gggcagagcaaaggaggcaggaggtggtgcagccccggaccccggagaggcccagtgactgcagcccaatacctgctgccgttcgatgaaccagggaggaatggagggacatgttcctaaaagcaaacctcattccaaaggggctgccaaggatatctgggtagttggccaccacagcgcttcngtgagcccttggaccgaggcatagcctgggtcatcctgggggtctccttcaaggtttgccttgactctataggagcttcatgcaaaatcatgggcaccacttccctcctccagaggcgacagtcctgccagcccttgaggagagacctggtcccctgtaagatggtgattccaccccaggcctttgtgtcaacccagcccggcttaggggaaacctcctttgtgggctgggctgattgctatcaagaagggaaatgagcacacgtgcccacccctggggcaggcatgagggagggtgtgccagggcccggacaggagagccagcccaagactgcagcccagggtctgccaaagccctggaggtttcaggaggggtctctggacccctgtctaatggatccctgtgggcctgacccnnccctnnngnnnnggncacnttgttggaagtcctggccctcanggtccagtccaactagaggtacatgcctccttcttcccatcactcacccccacaggc

SEQ ID NO: 2342 - DNA, 700 bp, Homo sapiens
  misc_feature (1)...(700): n = A,T,C or G
gagccagcccaagactgcagcccagggtctgccaaagccctggaggtttcaggaggggtctctggacccctgtctaatggatccctgtgggcctgacccnnccctnnngnnnnggncacnttgttggaagtcctggccctcanggtccagtccaactagaggtacatgcctccttcttcccatcactcacccccacaggcctagtggaattttctggggtacccgccacaggcaagaacctgggcctcagtcactgtgacaagctcctccgccaccctttccatggcatcacaagtgtcagatttaatctgcccatgacctcggttgtatttccgctggtggccctgatgacatcgcctggttttgtcaccacaaangcagctcagggttcttggccagccaagcagtgcaaccagatgtcccctgctcacctgagcagagagctcaggaaaaagccaccgagcgggcccagctggagagccctggcctcctgtcccaancnngntctgcactccatccccaagacctacacagcctccacctgtgcaccctcgcctttctattccctgctgcagggtcatggcttccttggggcccagtcggngcagagcagaccctccatcccaggcccagtctaatagagaagacagttggagaatccccatttagaatgatatgcctgtgggagacagaagcccag

SEQ ID NO: 2343 - DNA, 700 bp, Homo sapiens
  misc_feature (1)...(700): n = A,T,C or G
cnngntctgcactccatccccaagacctacacagcctccacctgtgcaccctcgcctttctattccctgctgcagggtcatggcttccttggggcccagtcggngcagagcagaccctccatcccaggcccagtctaatagagaagacagttggagaatccccatttagaatgatatgcctgtgggagacagaagcccagaaatgaggcagcctcatccagcctgcaccatcagagaagacaggaggaaaggacagctatgacctaaaggatgatctggagccaggcaagccacagaagaagtgttccctagggagtgctgggtttggggctgcaggtgctccatctgttggcctcaatccagggctccaatatctggatacctggggtggccatatggttcctattgttattaataagttatgggctttcagtgtctgtcactctcttgttacccacctgaaatacaaagctttggaagatgcattcctattgcatttatcatatctatcgcagacaaaaccaagagctccccgttctcaaagaagctgcccccaaactgtgaggtgacaaggttggggcataaatgctaagaacctggcagtccaggccctcaggaaatgctctcttaagtgggggagacttcacatggagcattagttgtgtagatgatgttgccatgcgaagtcttgtctgcctcc

SEQ ID NO: 2344 - DNA, 700 bp, Homo sapiens
tcatatctatcgcagacaaaaccaagagctccccgttctcaaagaagctgcccccaaactgtgaggtgacaaggttggggcataaatgctaagaacctggcagtccaggccctcaggaaatgctctcttaagtgggggagacttcacatggagcattagttgtgtagatgatgttgccatgcgaagtcttgtctgcctcccagggagagaggggaagggccggcctgggtgggcagctgcaggtcagagctgtccagggaaggacaggaccagatgctagctaggcaggggcacagacagacccaggtgagctcagagccaggctgcctctcagccgtgcctgctctgtcttatcttccttggtgaggtgaggagaaaccttttacattgtttccagccttactgatcttttctttacagaaaatgatgaataagttgatgtgtttgtcgtggaggttccatatcagaaaagagtatcagtccactggggcttctccccacacctcatcatcccccccaacccccacaccccctgaatctcctgcaccgccctcacccgtgctgggcctttacagaggatgtgggccaggccacttcagatccacacaggttagggaagaccacggtacctccaagcagtacagatatgtggagaccgttttgcctccccctcctcctcatccttcttcctctcagcctc

SEQ ID NO: 2345 - DNA, 700 bp, Homo sapiens
cacctcatcatcccccccaacccccacaccccctgaatctcctgcaccgccctcacccgtgctgggcctttacagaggatgtgggccaggccacttcagatccacacaggttagggaagaccacggtacctccaagcagtacagatatgtggagaccgttttgcctccccctcctcctcatccttcttcctctcagcctccaaaagcccctacccacaatggccattagaatccagactaaagacaacttcttgaacatcatccttgaaatccagtggcaactgagcacgccctctatgagtagctggtgccagatgggcacagggtaggaacagctccgctcggccccaggccaggcactcatgggttcttgctcttcccctgcagaaaggtgagatccaggagcaatggatcctgaggtgggcacacagccccgaagtcccactgccctccctaccagtcgtcactgccattgtattgctggtcactgctctgggcttgggcacatttgggtgaggcgcacctgcagggtcacactggagtcagcctttatctggcatcttcactgcagatgcatccaccagcctattctttgcctcatggaggatgtgcgtggtagatgttctttgccaagtgtgggagttgtaatattcacattggcacagctggcttccttctttttgcatcctggaagctggtt

SEQ ID NO: 2346 - DNA, 700 bp, Homo sapiens
gggcacatttgggtgaggcgcacctgcagggtcacactggagtcagcctttatctggcatcttcactgcagatgcatccaccagcctattctttgcctcatggaggatgtgcgtggtagatgttctttgccaagtgtgggagttgtaatattcacattggcacagctggcttccttctttttgcatcctggaagctggttcagaaagtgcccgtataccccaggcccttgcccagtgcatctggagccaggaggcatgatggtccctgccctgccggcctgtgtcagactgtgctgtgacccgcttggctgctgtgctcctaaagcagctgggttcctcctggggcctgggcaggacagagctgggggaggtgatgggggaactagtgaaggccaccccagaaaggaggcaggggaatggcaaacaaggccacaaggacagcccttcctggccgtaccacacacacttggcccctgtagaacaccacctttctgaagcctaacctggctgccttactgaacacctcaaagctctttaaacctcatcttctttatccatttggaacaatccaaagatgattgaggtgtgtgaggctggggagcgtccctctgtcactggagtctctgtgttcccagaagagcccgttccgggtcaaagtacctgcccttgtcctgccctttcccaaacaggaacagcattt

SEQ ID NO: 2347 - DNA, 700 bp, Homo sapiens
aacctggctgccttactgaacacctcaaagctctttaaacctcatcttctttatccatttggaacaatccaaagatgattgaggtgtgtgaggctggggagcgtccctctgtcactggagtctctgtgttcccagaagagcccgttccgggtcaaagtacctgcccttgtcctgccctttcccaaacaggaacagcatttccactccacctctgccccccaggttcttcccctctccactgccagcagcccctccagggctgggccagggccaccacccaggaccttctcagtcttttcaaaaggccctcctggtctatttggcttccagaagctgactggcctcttttgtctctggcccacaggaactcctgcaaaccttgcccatctccacacctacaccccagggaagctgccacctgggctgggatgcccactgccccaggctgagcaaggtacctgccacgacccttccaccttctctacacctgacccaatgttctggtttcttcaagggaaaaacagcggctgcacatcgaagaaagcaattctaataacttgttgaatagcttcccgagaaccctgggtgatgttgggctcttgctaccaaccaaatctctcatgcctttgttcaggctcttgaactcccaggcctgagagctgggctcaggtcctgggtcaccaatattccttctcgatat

SEQ ID NO: 2348 - DNA, 566 bp, Homo sapiens
ctggtttcttcaagggaaaaacagcggctgcacatcgaagaaagcaattctaataacttgttgaatagcttcccgagaaccctgggtgatgttgggctcttgctaccaaccaaatctctcatgcctttgttcaggctcttgaactcccaggcctgagagctgggctcaggtcctgggtcaccaatattccttctcgatatcccaggaatactccactccttgttacagacgttggcagttgaaagtttagctctggaatgagccgctcagttttcatcttggggatactgacaatcatgtgtatttatgttgcagattacttaacggttattcactttgttgtgaaaatattttattttattaagggagccctcttaggagcctctgagcagagctcagagcgggtacgagagcatctacatttctctctcaggtttcagtaaattccttctcctctgggaaagtgagcactttgtagagggtccctttgtcagcagtgctgcatttctagaaggcttctccatttgacttgggtctgggttgcaatttccacactccacagttaa

SEQ ID NO: 2349 - DNA, 700 bp, Homo sapiens
  misc_feature (1)...(700): n = A,T,C or G
cactgcaacctctgcctcctgggtcaagcagttctcctgcctcagcctcctgagtagctgggattacatgngactgccaccacacccagctaattttttgtatttttagtaaagatgaggtttcactatgttggccaggctggtctcaaattcctgacctcaggtgatccacctgcctcagccncncnnanngnnnngnnnnnannngngnnnnncnnngtgcccagccaacaatatgctttattatctgatagagctagtctctacttattactcttctatttcagaaccttcctagctattcttccatgcttattctccctaaggcattttggtatcattttgttaaaagtcctacttaccatttcactttctgcatctgctctaaggtttctggaagagtcattcccaaactttcagggaaaaaaagggtgaagattccaatcaggacagtcagactacccatgacgatgtagggcagcattctgttgtaagcacctgtaaagcccgggacataagaacatcaatcagataggaggactctctgggcactcttgagcatcattttgtgaagttggtgaacagtataagagaatggatttaaatctgaacattttcagagaaaaaaaagtaagcaaaatatcagtttctttttggcagatgacattgtgcatgtctataatccttttgcattatcata

SEQ ID NO: 2350 - DNA, 700 bp, Homo sapiens
  misc_feature (1)...(700): n = A,T,C or G
gtaaagcccgggacataagaacatcaatcagataggaggactctctgggcactcttgagcatcattttgtgaagttggtgaacagtataagagaatggatttaaatctgaacattttcagagaaaaaaaagtaagcaaaatatcagtttctttttggcagatgacattgtgcatgtctataatccttttgcattatcataaggcttttcattctttcctgtcaactggtatcctctaagctactactcagtcatgtgtgacagatgttcctttggtagagttctttgcctaccagagttctcctcttaaggtggaggtaattggaaatgggggatgggaggacatcaaggagaaggaggttaaccaggatgtttcagggataggttttggcnatgataggtctggcatgactctgcttttgcccaaactagtaggctgcagtggaaagttaggtccacagggctatgagactcaaaaaaaaaaaaaaaaaaaaaaaaaacaactaagtattatgttcacttcagattaaatcagtaaattataagtatcaggcacattctgtaaaggcactgtgtgcctggatttggcttctttttggagcacttacatgtcttgggttaatatgtaatctctttgtgaagctttactcacacaggagaaaaacagatcctcatcttgctttgcccctgtatacatacag

SEQ ID NO: 2351 - DNA, 700 bp, Homo sapiens
aactaagtattatgttcacttcagattaaatcagtaaattataagtatcaggcacattctgtaaaggcactgtgtgcctggatttggcttctttttggagcacttacatgtcttgggttaatatgtaatctctttgtgaagctttactcacacaggagaaaaacagatcctcatcttgctttgcccctgtatacatacagagcttacagaggaacagcacacccatggatttcatttgacccaaaacataaggaaaatattgttattgcagcttctctgaggcctctgtgtcactaacaggagtagctgtgtggagtaggagactcttggactccctgtcttatgtaccagtgtctgaccactggaccatctgagcatagtttgaaatagtttgaaagtacagggaaggacaaagggaaaaataacaccactctgtataatctgctatctcaggtgtggcacagggcaactgtgcagaatatgtttgttaggaaaatgtttctctttctctgtaagggtttggattatacctttcctgagaattcatacatgttttcaggtgtgtgtgtgtgtgtgtgtgtgtgtgtacgtgtgtaccagtaggtaaccaattgcccaattgatgaggtgtgtctgcatttctcaccagtagagtccttaatgaggaccaggcatggggtgtcagatcctacatcagatt

SEQ ID NO: 2352 - DNA, 700 bp, Homo sapiens
tctctttctctgtaagggtttggattatacctttcctgagaattcatacatgttttcaggtgtgtgtgtgtgtgtgtgtgtgtgtgtacgtgtgtaccagtaggtaaccaattgcccaattgatgaggtgtgtctgcatttctcaccagtagagtccttaatgaggaccaggcatggggtgtcagatcctacatcagattgaacatgccgctgaaacacctctgtagtttcatttcagattgacacctttgagtatataaaaactaaaattgtcttcattacaaagatatcataaagtgaaaatacaaatggtaaactaggaaaaatatttacaacatatatacaaggggctaatttcttccattgcaaagagtttgcacaagtcaaaaagaaaaagatgaatacacctgttgcaggaagttagggaccccgaaaggagggactggctgaagccatggcagaagaatgtggattgtgaagatttcatggacatttattagttccccaaattaatacttttataatttcttacgcctgtctttactgcaatctctgaacataaattgtgaagatttcatggacacttatcacttccccaatcaacacccttgtgatttcctatgcctgtctttaatctcttaatcccgtcatcttcataagctgaggaggatgtatgtcgcctcaggaccctgtgatgatt

SEQ ID NO: 2353 - DNA, 700 bp, Homo sapiens
  misc_feature (1)...(700): n = A,T,C or G
ttccccaaattaatacttttataatttcttacgcctgtctttactgcaatctctgaacataaattgtgaagatttcatggacacttatcacttccccaatcaacacccttgtgatttcctatgcctgtctttaatctcttaatcccgtcatcttcataagctgaggaggatgtatgtcgcctcaggaccctgtgatgattgcgttaactgcacaaattgtttgtagagcatgtgtgtttgaacaatacgaaatctgggcaccttgaaaaaagaacaggataacagcaatgttcagggaacaagagagataaccttaaactctgaccgctggtgagtcgggcagaacagagccatatttctcttctttcaaaagtaaatgggagaaatatcgctgaattctttttctcagcaaggaacatccctgagaaagacaattcgtccctgagggtaggcctctaaaatggccactttgggggcagctgtcttttacggttgnagctgtagggatgaaataagccccagtctcccgtagcactcccaggcttgttaggatgaggaaattcccacctaataaattttggtcagaccggttgtctgctctcaaaccctgtttcctgataagatgttatcaatgacaatgcgtgcccaaaacttcattagcaattttaattttgccccggtcctgtggtcctgtgatctc

SEQ ID NO: 2354 - DNA, 700 bp, Homo sapiens
  misc_feature (1)...(700): n = A,T,C or G
gtagggatgaaataagccccagtctcccgtagcactcccaggcttgttaggatgaggaaattcccacctaataaattttggtcagaccggttgtctgctctcaaaccctgtttcctgataagatgttatcaatgacaatgcgtgcccaaaacttcattagcaattttaattttgccccggtcctgtggtcctgtgatctcaccctgcctccatttgccttgtgatattctattaccttgtgaagcacgtgatctctgtgacctacaccctattcgtacactccctccccttttgaaatcactaataaaaacttgctggttttatggctcagggggcatcatggaacctgccaatatgtgatgtctcccccggacacctagctttaaaatttctctcttttgtactctgtccctttatttctcagaccagctggcacttagggaaaatagaaaagaancctatgtgaattatcagggctgaattttgcccgatatacaccattaaagaatgggcaaagaaggccaggcacagtggctcatgtctgttatcccagcactttgggaggccaaggcaggtggatcacctgaggtcaggggtttgagaccagcctgaccaatatgatgaaaccccatctctactaaaaatacaaaaaaaaanaaaaaattagccggacatggtggcatgcgcctgtagtcccagc

SEQ ID NO: 2355 - DNA, 700 bp, Homo sapiens
  misc_feature (1)...(700): n = A,T,C or G
ttaaagaatgggcaaagaaggccaggcacagtggctcatgtctgttatcccagcactttgggaggccaaggcaggtggatcacctgaggtcaggggtttgagaccagcctgaccaatatgatgaaaccccatctctactaaaaatacaaaaaaaaanaaaaaattagccggacatggtggcatgcgcctgtagtcccagcaactcaggaggttgaggcaggagaattgattgaacccaggcggcggaggttgcagtgagctgagattgcgccactgtanctccagcctgggtgacagagtgagactccatctccaaaaaaaaaaaaaggggcaaagaacatgagcagtcagttcactgaaaaataaataaaatggccaaaaaatacacaaaaacatgctcaacctcattcataattaataaataggaatgaaagtaacaatgatatccatttttcacataacagataaccaatgattaaaaaattaggccaggtgctgtggctcaaacctgtaatcccagcactttgggaggttgaggcgggtggatcacttgagcccaggagttngaaaccagcctgggcaaactggcaaaatcccgtctntaccagaaaaaaaaaaaaattagctgggcttgacggtgtgcatgcctgtagttccagctagttgggagtctgaggtgggaggatctcttgagcctggg

SEQ ID NO: 2356 - DNA, 700 bp, Homo sapiens
  misc_feature (1)...(700): n = A,T,C or G
gctcaaacctgtaatcccagcactttgggaggttgaggcgggtggatcacttgagcccaggagttngaaaccagcctgggcaaactggcaaaatcccgtctntaccagaaaaaaaaaaaaattagctgggcttgacggtgtgcatgcctgtagttccagctagttgggagtctgaggtgggaggatctcttgagcctgggggattgaggctgcagtgagctgggaatctaggatcgcaccactacactccagagtgagaccctgtctcagaaaaaaaaaaaaaaaaaagaattaggtaatctttattgttggtgagattattgaaaaccactcttacctattaataattagattataattggcacaatatgtagagttcaatttgggaatatctatgaaattttttaatggctctctttgctccaggaattttacttctatgaatctacctgtaaatccaaatatacgtaagtaaattcacaaagggtgtaggagcataggnagaatgttcgttgtaatgnttatttgtaatagcaaaaacctggaaatgacctacatgtcctccattcattggagcctggttaaataaattatgtgtttcnagtataaaagtaagattttncattgtgaaaacttcaaatggcatggaatgtactggaaaaaagtacaagttcacctcccctctcccaggaggatccct

SEQ ID NO: 2357 - DNA, 700 bp, Homo sapiens
  misc_feature (1)...(700): n = A,T,C or G
gnagaatgttcgttgtaatgnttatttgtaatagcaaaaacctggaaatgacctacatgtcctccattcattggagcctggttaaataaattatgtgtttcnagtataaaagtaagattttncattgtgaaaacttcaaatggcatggaatgtactggaaaaaagtacaagttcacctcccctctcccaggaggatccctagaaaaccaacatgaactgtttggtgagtagccctacagacattttgttttgcacaacattatgtacacacacacatatatatataattttttanacggcactctttgctccaggaattttacttctgtgaatctatctgtagattatacttacatatacttattttaaaatgtacttatatacatttttaaaaggaggtacctatttaaaaagaaggtaaaggagcaatatgtaactatttggaaggatattctgatacaatgttaagtttaaaaagttttaacatatataatgttatttgtgtgtttattctttttattttttattatttttatttatttttgagacagagttttgctnttgttgcccaggttggagtgcagtggtgcaatcttgactcactgcagcctctgcctcctgggttcaagcaattctcctacctcagcctccagagtagccgggattacaggcacctgccagcacacctggctaatttttt

SEQ ID NO: 2358 - DNA, 700 bp, Homo sapiens
  misc_feature (1)...(700): n = A,T,C or G
tgtgtgtttattctttttattttttattatttttatttatttttgagacagagttttgctnttgttgcccaggttggagtgcagtggtgcaatcttgactcactgcagcctctgcctcctgggttcaagcaattctcctacctcagcctccagagtagccgggattacaggcacctgccagcacacctggctaatttttttatttttagtagagacagggtttcaccatgctggccaggctggtcttgaactcctggcctcaggtgatccacctaccttggcctnccaaagtgctgggattacatgcntgagccaccacgcctgagttgcnngtgtgtttaaaaaattatatacatacntgngnacatgatgtngtgcaaaacaaantgtctgnancnctactcaccagtttgngatnggctttctagagctcctcctgggagaggagaggngaacttgtactttntttccngtacattctatgctatttgacgttttcacaatgaaaatcttacttttancattgaaaactaatttaaaggaagaacaaatgcacaagatgcagctcaccgaggtaaacaaagtagggggcaatgatgctgcccactctggaggccgtggatgtgacccccaccgccatgttcctgaccagggttgggtagagctcagcagtgaagacatacagcatggagaaagcaga

We claim:

1. A method of predicting the likelihood that an individual is susceptible to Crohn's disease, comprising the steps of:
   a) obtaining a DNA sample from an individual to be assessed; and
   b) determining the nucleotide present at nucleotide position 218 relative to the 5' most nucleic acid in SEQ ID NO:1127, wherein the presence of a guanine at nucleotide position 218 is indicative of a greater likelihood of susceptibility to Crohn's disease in the individual as compared with an individual having a cytosine at nucleotide position 218.

2. A method according to claim 1, wherein the individual to be assessed is an individual at risk for development of Crohn's disease.

3. A method of predicting the likelihood that an individual is susceptible to Crohn's disease, comprising the steps of:
   a) obtaining a DNA sample from an individual to be assessed; and
   b) determining the nucleotide present at nucleotide position 218 relative to the 5' most nucleic acid in SEQ ID NO:1127, wherein the presence of a cytosine at nucleotide position 218 is indicative of a reduced likelihood of susceptibility to Crohn's disease in the individual as compared with an individual having a guanine at nucleotide position 218.

4. A method according to claim 3, wherein the individual to be assessed is an individual at risk for development of Crohn's disease.

* * * * *